United States Patent 8,758,764 (PROTEINS AND NUCLEIC ACIDS FROM MENINGITIS/SEPSIS-ASSOCIATED ESCHERICHIA COLI) - sequence listing, part 6

SEQ ID NO: 10274 - DNA, 5126733 bp, Escherichia coli (residues 3,417,823-5,126,733 of 5,126,733)
  misc_feature (1)...(5126733): n = A,T,C or G
tgccttcgtcgagcactttttgcatcagttctaaatactgtttcatggttcctcaggaaacgtgttgctgtgggctgcgacgatatgcccagaccatcatgatcacacccgcgacaatcatcgggatggaaagaatttgccccatgctgatgtactgcacccaggcaccagtaaactgcgcgtcgggctggcggaaaaactcaacaatgatgcgaaacgcgccgtaaccaatcaggaacaagcctgagacagctcccattgggcgcggtttacgaatatacaggttgaggataataaacagcaccacaccttccagcagcagctcgtaaagctgtgatgggtggcgcggcagcacaccgtaagtgtcgaaaatggattgccactgcgggttggtttgcagcagcaaaatatcttctgtacgggagccagggaacagcatggcaaacgggaagttcgggtcaacgcggccccacaattcaccgttaataaagttgcccaggcgcccagcaccaagaccaaacggaatgagtggggcaataaaatcagagacctggaagaaggaacgtttagtacggcgggcgaagataatcatcaccacgataacgccaatcaggcctccgtggaaggacatgccgccgtcccagacacggaaaagatacagcggatcggccataaactgcgggaaattgtagaacagaacataaccaatacgtccaccgaggaagacgccgaggaagcccgcatagagtaagttttcaacttcatttttggtccagccactgcccggacgattcgcccgtcgtgttgccagccacattgcaaaaatgaaacccaccagatacatcaggccgtaccagtgaagcgccacgggtcctattgagaaaatgaccggatcaaactccggaaaatgcagatagctactggtcatctgtcaccacaagttcttgttatttcgctgaaagagaacagcgattgaaatgcgcgccgcaggtttcaggcgctccaaaggtgcgaataatagcacaaggggacctggctggttgccggataccgttaaaagatatgtatatgatccgcgctataaccccccgcgaatcagcccgcccatgccgcgacgctccataaaggcagcaacctgatggcgaacttcggtcgccagttgcgcttccagactacgctgcgcaagattttctgcttcagcaaaatcaatgcgccgcagcaggtattttacgcgcgctacagaacgtccgttcatagacagatggcgatacccaagcccaatgaggattgccacgcacatgggatcgcccgccatttcaccgcacaaacggagatcgattccatgtatttccgcttcccgggcgatcatcgccagagctcgtaacattgcaggatgaagactgtcataaatgttcgccacccgggtattgttgcgatcaacggccaggatgtattgagtcagatcgttggtgccaacagagatgaaatcgacccgctttgccagatgcggcagcataaataccattgacggcacttccagcatgatgccgatacgtggtttgggaatttcgtaaccgatcatctcctcgacttcacgtccggcacgttcaatcaggcggcgtgcttcgtcaacttcatcgaggcttgtgaccatcggcaacagaatattcaggttgcccgtagcggcattagcacgcagcatcgcccgcacctggatcaagaagatctccggctgatcgagcgtaatgcgaatcccacgccaacccaggcatggattctcttcgctaatcggcatgtaaggcagctgcttatctgctccgacatccagcgtacgcaaggtgacgggtttatcattaaacatttgcagcatcccctgatactgcgccacctgttcttcttccgacggaaaaccactttgcagcatgaatgggatttcagtgcgataaagtcctatgccatcaatacggctgcccagtttttcttcatgttccgggcttaaaccggcattgagcatgactttaatgcgttcgccgctttttaactgggcgggtaaattgacgtcatcttccgccagacggctaagctcgatctcttcactaattagccgctgatattcttgcagcagtaccggttccggatcgaccagcaattcaccgcgataaccatcgacgatcagcgtccgacgatgcagtaccgaaggctgaatatccgcgcccatcacggtaggtatccccagcgcacgtaccatgatcgcagcatgggagttggcagcgccatcgcgcacgacaacaccgactaagcgatcctggggcagctcagcaagcgttgtcgctgacagttcatctgccaccagaatgaaacgttccggccaggcgttcggcccttgattagcgtcatcaagatgaaacagcaatcgctgacccagcgcacgtaaatcgccagcccgctctttgagatagttatcgcttagcgcggcaaactgttcggcaaatttttcaatgaccgtttttaccgcccactctgccaccgagcctttatcaacctcggcaaacaattcgcgacgcagccgggtatccgaaagcaggtgtgagtaaagatcgaaaatagccgccgtttctttttgtgcaccggcagcaaagcgtttgctatagcggcgaaactcgttagccgcctcttccaacgccccggtcagtcgttcgcgttccagagccggatccagcgttgatgcctgatacacctgttccattaaaggtaacgtggcatcctgccagccttcggcaatcgccacaccaggtgctgccggtaatgcacggattcgcgtctggcgatattgcccaaacaaggcagtcaactgcgactgagaaagaatagctgccatctgggtggcaagcgtcaccaggaaggattcttcactttcgtcatactggcgcaactctcgttgctgtaccaccagtacaccaagcaactggcgacgttgaataattggtacgcctaaaaacgcgcggaaacgttcttcttttacggaggggatgtatttgaagctggggtgcttttgcgcatctgcaaggtttatcggttccgccagcctgccaaccaggccgacgatcccttcatcaaacgcgagcgttacagtgcgaccgcgtggttttttcagtccccgggtcgccatcaggtagtaacaacgtcgatcatgatcggccaggtagaccgaacagacctcggtatccatcgcaagacagatgtcggtaaccagaatatttaacgcctcattcaggcgtggtgcgctggctaccttttcgactatttcgcgcaggcgagtgagcataattggcgtgacttaacctcttttacgtcgataagcagatgcgttttgtggttttggcgtattttcctgcagtgacatcaccacactcgcgaactctttcattaccctacggtagacatcacgtttaaatgacaccacctgtctgactggataccagtaacttacccatcgccagccgtcaaactctggtgtactgctggtttgcatattgatttctgcatcgccgctcaccagctgcaagagaaaccatttttgtttttggccgatacaaaccggcttcgtgtcccaacgcaccaaacgtttcggtaatttgtagcgcaaccagttacgcgttgaagcaaggattcgaacgtctttgcggcttaatcctacttcttcaaacaattcacggtacatcgcctgctctgcggattctccggggttgattccgccttgcggaaattgccaggagtgctgaccaaatcgccgggcccacattacctgcccctggcgattacaaatcacgatacctacgtttgggcggtagccatcgtcatcaatcaccggactacctcaaaataaagctttatatacgaatgattgtttcatactccaggaagacggtaaaccactctctgcagggcattacacactaataacaattgaataactcacagttatgtgcagagttataaacagaggaaggggtggatagccgtttttattcaccttttctgtggatagagttgtgaagaactacggaattactacgggaaaacccggnnnnncattccattcattaattaattaatgaatgaatgnnnnnacataattgctgtttgttttttaaccaaggtatcatgacatgtcccaacctcgcccactgctctctcctcccgaaactgaagaacaattgttagcgcaagcacaacaactttctggttatacattgggagaactggcggcacttgccgggctggttacgccggagaatttaaaacgcgataagggctggattggcgtgttactggagatctggctaggtgccagcgcagggagtaaacctgagcaagattttgctgctctgggcgtggaacttaaaactatccctgtggatagtcttggtcgtccactggaaacaacattcgtttgtgttgccccgttaacgggcaatagcggggtgacctgggaaaccagccacgtgcgccacaagctcaaacgcgtgctgtggataccggttgaaggcgagcgcagcatcccgctggcaaagcgtcgcgtaggatcaccgttgctgtggagcccgaatgaagaggaagaccggcagctacgcgaagactgggaagaattaatggatatgattgttctcggtcagattgagcggatcaccgctcgtcacggggaatatttacagatacgaccgaaagcagcgaatgcgaaagcgctgaccgaagctattggtgcccggggcgaacggattctgacgctgccgcgcggattttatttgaagaagaatttcaccagtgcgctactggcccgtcattttctgatccagtagccatcgctttgacctgccgctttccgggcatataattaccgcttcatttttttggcagggctttttagatgttatttgcatggataaccgatcctaacgcctggcttgcgctcggtacactgacgctgctggagatcgttcttgggatcgacaatattattttcctttctctggtggtggcaaagcttcccacagcacaacgtgctcatgcgcgccgtctggggttggcgggagccatggtcatgcgtctggcgctgctggcatccatcgcctgggttacgcgcctgacgaatccgctttttacaatattcagtcaggaaatttccgcccgtgatttgatcctgcttctgggtggcttgttccttatctggaaagccagcaaggaaatccacgaatccatcgaaggtgaagaagaagggctgaaaacacgcgtttcatcattcctcggcgctatcgtgcagattatgctgctggatattatcttcagcctcgactcggtgattaccgctgtgggtctgtcagatcacctgtttattatgatggctgccgtggtgattgccgtaggcgtgatgatgttcgccgcgcgctcgattggtgattttgtcgagcgccatccttcggtaaaaatgctggcgctctctttcctgattctggtgggctttaccctgattctggaaagtttcgacatccacgtaccgaaaggttacatctacttcgcgatgttcttctctattgcggttgaaagcctcaacctgattcgcaacaaaaagaatccgctctgatactccgtacgctctcctgcgggagggcgtactcactcctgttaccctcacagtttaagattttcctgctttcaagatatataacgtcggtttataaacagactattatcataggtgggccaaatgaggataaccggatgaaaaaatgggcagtaataatttctgcagtcggactggcgtttgctgtttccgggtgttccagtgattacgtcatggcgaccaaagatggccgtatgattttgaccgatggaaaacctgaaattgatgatgataccgggctggtgagttatcacgatcagcaaggtaacgcgatgcaaattaaccgtgatgatgtttcgcaaattattgaacgttaacaaataaggtcagcatccggctggccttaagatttttctctttcccttttcccttccctctgccatttttatattccttatgtcgtgattataaaaaggaaacggctatgcaatatcaccgtataccccacagttcgctggaagtcagcacgctggggcttggcacgatgacgtttggtgaacagaacagcgaagccgacgcccacgcacaactcgactatgccgtcgctcagggcattaaccttatcgacgttgccgaaatgtacccagtacctccgcgccccgaaactcaagggctaaccgaaacctacgtcggcaactggctggcgaaacatggcagccgcgaaaagttaattatcgcctccaaagtgagcggaccgtcgcgcaataatgacaaaggcatccgcccggatcaggcgctggatcggaagaatatccgcgaagcgctgcatgacagcctcaagcgtctgcagactgattacctcgatctctatcaggtgcactggccgcagcgcccaaccaactgcttcggcaaactcggttatagctggacagattctgcgcctgcggtttcgctgctggatacgctggacgcactggcagagtaccaacgcgcgggaaaaattcgttatatcggcgtgtcgaacgaaactgcatttggcgtaatgcgctacctgcatctggcggacaaacacgatctgccgcgtattgtcaccattcagaacccctacagcctgttaaaccgcagttttgaagtaggtctggcagaagtcagccagtatgaaggggtcgaactgctggcctattcgtgcctgggtttcggcacactgaccgggaaatatctcaatggtgcaaaacccgctggcgcacgtaatacgctctttagtcggttcacccgctatagcggtgagcaaacgcaaaaagccgtcgcggcgtatgttgatatcgccagacgtcatggcctggaccctgctcagatggcgctcgcatttgtacgccgtcaaccgtttgttgccagcactctgctgggcgcaaccacgatggagcagctgaaaactaacgtcgaaagtttgcatctggagttgagcgaagacgtattagctgaaattgaagcggtgcatcaggtttatacgtatcctgcaccataagattaacgccggttaaaaccggcgttaaatattaatgacggcgctgccagatccacagcgccgttattgccagcgcaaacagcgcaccgaagccaatgccaatgggcacgaccgggatgcctaccattaccgccagcgagtaaatgcccagcatcaacaacatggcgctgttttcgccaaggttttgtactgcaatcgcattccccgccccgacgctttttttaccccgctcctgtagcaacgcattgagcggaacgacaaaaaagccccccagcacgccaatcagcatcaacaaagcataggctggcagcagctcgtgttgcagggagaaaatcagtaccaccacgccaatcaaaatcccggctggcatacagcgtgacacggtttccagcgtaactaacttcgctgccgcacctgcaccaaccacgataccaatcgctaccatcgcgttgagataggtcggcgtagcgttatcggtaatacctagcgccaccggtacccacagcaccaacaggaaacgcagcgtgacacccgctccccagaataaactggtgcccaccagcgaaaaacgcgtttcaccattgcgccatagcgaggtgcaggcattcaggaaactgcgggtcatgctgatgagattccaggactgccccggacgcgccgccgccagtttgggaatgtagatattggcaacgaccgcgccaccgtaggccagtgcgcatgcgaccagggcaaccagaatatgccagtcagccagaacaccaccagctacggaaccgagcaaaatcgccgctatggtagacgcttccattaaaccgttagcttttactaacttactacccgtggttaattcgccgagaataccgtatttcgccggtgaataggctgcagcaccaacacccaccaacgtatagccgagaaacggattgataccaaagcagatactggctgcgcccagtagcttcaggccgttggcaaacatcatcacccggcctttggcgaagctatccgccacctgcccgacaaacggcgcaaaaagaatgtaagcacctacaaacaccatttgcaggatgggttggctccactccggatagaactgcgctttcagtaacgccagagtggcaaacagtagcgcattatcgccaaacgcagagagaaactgcgccacgataaccgctttcatccccttcgaccacaacgaagtgttagtgtgcactgactcactcatcgtgttgttccgcttcgtctacccagcttttcaaagtgacaaagtcaggtttgccgctgccaagtaatggcatctgtttcagatagcgaatatcgcgcggtacagcaagctccggcacgccgtgctcgcgggcatactgttgtaacttatcgcgcgtcagttcgttatctgtggtgaaaagcaccagtgcctcgcctttgctggcatcgctcttaatcgcagtggcatggactttatctggcgaaacaccaagtgccagttgttccaccatttccagcgacaccatttcgcctgcaattttggcaaagcgttttgcgcggccctgaatctgcacaaagccctgctcgtcaaaacgcacaatatcgccagtgtcataccagtcgcgctccatttcgccgcgaatattctcggcggtgggcacttccagtacaccaggcttctccacccgcagatagccgttcattatgttcggccctttcagttgcaggcgtccgccctcttcgataccaggaaccgacaacaggcgcgcatccattcctggtagaatacgccctaccgtaccgggtttcgccgccatcggtacgttgatagaaacgacaggcgcgcattcggtcacaccgtagccttcaaggatgcgcaggccaaatttatcctgccaaagctgtttagtactttcttgtagtttttctgcgcctgccaccacatagcgtagacgatagaagtcatacgggttggcgaaacgcgcgtagtgaccgaggaaagtggaggtaccgaacaacacggtgcaactgcggtcatacaccaactccggcacaatacggtaatgcagcgggcttggataaaggaacacttctgcacctgtgagcagtggcgtaaacaggcctaccgtcagcccaaaggagtgaaacagcggtaacgccgacataaagcgatcgttggtggtgaagtcggcaatcgttttaatctgctcgacattcgccagaatgcttttatggctatggacgacgcctttcggatggccttcagaaccggaggtaaaaaggatcagcgcctcttcttccggctgctgtttaacctgtgccagacgcggcatcagcaaatgagcgaagatccatactttgtcggcagtggtgacatctgcttttaaatcttccagatagacccagcgcacctgagtaagttgctccggcagatgccagagtttgcctttatcgagaaactggcgggaagtgaagatggttttgatttcagccgccgtaatagcactggtcagcccttttaccccagcagtgtagttcatcattgcgggaatgcggcgacgggcgatggccccaaaaatcactgccgcactgatgcctgcattgggcagcattaagccgatgcgttcgccttcaacactgtatttttcaaggatgcgtccaacaaacagcgttttcgtaagcaatttgcgataggagtccggggtaaagttaacgtcttcgacacatttcttcccggctccgaagcggtacattgcgctcagtaaagattcgtacagcgtttcacgcgggcgcaccgccatacgcgcttccatcattatttgatgcagcatttcgccagcgattttgcgacggtcacgggcacgcggcgcatccggcatctccacctgcgttggtggcaaaatatgcagagtaatttgcgggaacaagcgacgtttaaccagacctttcaggcggctgaagtgcgtaagttccgccccttcaatacgcacaggaataaccgttgcaccagacttcgccgcgacaaatcccgcgccatcgtagattttcatcagcgagccagtggtggtgatgcgtccttcagggaaaatcaccactggtcgtccctgttccaccagacgtaccagatgtttaatcgccataggttgcgtcgggtcgagaggaacaaagtcgataaatgatttcagccaacgcatataccactgttggcttattgaggtgtaaacggcaaataccggacgtacgggtaaaaacaatgccagcagtatgccatcaataaaagagacgtgattaggcgtaattagaacgcgctcgcccttcagtgccttggtgtcacccgtaacgcgaacgcgatacaaaacacggcacaaatttcgaaaaaagctaaaaagcattccaactccctttgctctgattcagtaaaagcgaatggagggagattacacgagataaagaacgcgagcgacagtaaattaggtgcgaaaaaaaacctgcgcatccgcgcaggttggtgcaagagactgggtacgaagagcgtaccgaataatctcaccaatcaatacctctgggatcttgattgtggtctgcacgacgactcttcgccagcgagaaaacgcaaaggaatgaagggaaatgcaacgaggtgtgtaaattgtcggttactgttacagattgatgaccggcaaaaaaaaacctgcgcatctgcgcaggctggtgtaattcatgtgctcaacccgaagttgacttcacctatcaatacctctgggatcaccgctttagcaacctgaagccaaacgccaccagcggtcaatcgcaacagcgtttcgcaaagtgtaaccaaaggtttgcaatctctttttttgtcttacttatttgcgtttggctcacattcccacaatgaaaacacgccgccccttgaaccaacgggcgttttccgtaacactgaaagaatgtaagcgtttacccactaaggtattttcatggcgaccataaaggatgtagcccgactggcaggcgtttcagtcgccaccgtttcccgcgtcattaataattcacccaaagccagcgaagcttcccggcttgctgtgcatagtgcaatggagtctcttagctatcacccgaacgccaacgcccgtgctctggcgcagcagaccactgaaacgatcggtctggtcgttggtgatgtttccgatccgtttttcggcgcaatggtgaaagcggtcgaacaggtggcttatcacactggtaattttttattgattggcaacggttaccacaacgaacaaaaagagcgtcaggccattgagcaactgatccgccatcgctgtgctgcgctggttgtccatgccaaaatgatcccggatgccgatttagcctcattaatgaaacaaatgcccggtatggtgctgatcaaccgtatcctgcctggctttgaaaaccgttgtattgctctggacgatcgttacggtgcctggctggcaacgcgtcatttaattcagcaaggtcatacccgcattggttatctgtgctctaaccactctatttctgacgccgaagatcgtctgcaagggtattacgatgcccttgctgaaagtggtattccggccaatgaccggctggtgacatttggcgaaccagacgaaagcggcggcgaacaggcaatgaccgagcttttgggacgaggcagaaatttcactgcggtagcctgttataacgattcaatggcggcgggcgcgatgggcgtgctcaatgataatggtattgatgtaccgggtgagatttcgttaattggctttgatgatgtgctggtgtcacgctatgtgcgtccgcgcctgaccaccgtgcgttacccaatcgtgacgatggcgacgcaggctgccgaactggctttggcgctggcggataatcgccctctcccggaaatcactaatgtctttagtccgacgctggtacgtcgccattcagtgtcaactccgtcgctggaggcaagtcatcatgcaaccagcgactaaccgcagttaaagcaattccagcgccagtaattcttcaatggtctggcgacggcgaatcaaccgcgcctgaccattatcaaacagaacttctggtaacagcggacggctgttgtagttggatgacattgatgcgccatatgcccctgtatcatgcagtaccagataatcacacgccttcacttccggcaaggcgcgggtttcaacatttcccccttcctgctgggtaaagacatcgcccgattcacataacggcccggcgacgacggtttccaccgttggtgcgtgttccagagaacgaccatcagctgccagggcactgatatggtggtaactaccgtacattgccgggcgcatcagatcgttgaacccggcatcaaccagcacaaagtggcggctacccatttgtttgacgctccgcacttgagtaattaatacgccagcctgcgctaccagaaagcgacccggttcaatttccagtttcacaggatggcccaaatggcgggcgatttgctcacgcgcggcattccacagaccataataatgttcggtatcaaccgcctcttcaccctgttgataaggaatagaaagcccaccgcccgcagaaatagcctgtaaatcctgaccgaattcgaggacctgacgcaccatagcaccacatacctgttccagatgggcataatcgacgccagaaccaatgtgcatgtgaatgccgaccagctgtagatgatgacgttgtatcacgtccagtgcggcgggcagatcggtgtaccagataccgtgcttgctgttttcgccaccggtattggttttttggctatgcccgtgaccaaaccccggattaacacgcagccatacccgatgccctggcgaaacctgacccagttggtcgagcatatcaacagaacccgcattcaccggaatttgcaattcactgacgcgttcaagcgtcgcctgatcgataacatctgccgtaaaaacaatatcatcggggtgcgtttgcggattgtaacccgccgccagtgcacgctctatttcgcctaacgagacggaatccacttttacgccctgctcacgcattaagcgcaaaatatgaatattggaacaggctttctgtgcaaagcgcaccacatcaaactgtttcagcgctgcaatctgccgacgaataatttgcgcatcgtagacccacaccgggcagccaaattctgcgggcaaacgcagcagattttcggcggtgagatcggtatcagtgctgaacagtgaatgtggcataacaaactccagataagtgcttttttatgattacgccacatcataaaaagaataaaaaatatcgatttatgtcgagtctatgcaaaaatgatatggattaccggattgcgagagagcgctaatggccgcagttaacttacgtcatattgaaatttttcatgcggtaatgaccgccggaagcctgactgaggcggcacacctgctacacacctcacagccaaccgtcagccgcgaactggcgcgctttgagaaggtgatcgggctgaaattgtttgagcgcatacgtggacgattacatcctaccgtgcaaggactgcgtctgtttgaagaagtgcaacgatcctggtacggactggatcgcattgtcagtgccgcagaaagtctgcgcgagtttcgccagggagaactgtctattgcctgcctgccggtcttttcgcaatcttttttaccgcagctcctgcaaccctttctggcacgttatcccgatgtcagcttaaatatcgtgccccaggaatcaccgctacttgaagagtggctctcggcccagcgtcatgatttaggactcactgaaacgctccatacgcctgcgggaacagaacgtaccgaattactctctttagatgaagtgtgtgtgttacctccgggccatccgctggcggtaaaaaaggtattaacgccggatgattttcacagtgagaactacatcagcctttcccgtactgacagctatcgccagttgctggatcaattgtttactgagaatcaggttaaacgacgcatgatcgtagaaacccacagcgccgcgtcagtctgcgcaatggtacgggcgggggtaggcgtttcggtggttaacccgctcaccgcactggattatgcggcaagcggtttagtggtgcggcggttcagcattgcggttccattcaccgtcagcctgatccgccccctgcaccgcccgtcatcagcgctggtgcaggcgtttagtgagcatttacaagcgggattaccgaaactggtcacttctcttgacgctattttgtcgtcagctacgacagcataaaagcgacagcatcctcggcatggatcgccgcggtatcaaacacaggcagaacactgcgctcttctggcaccagtaaaccaatttctgtgcagccaaaaatgacgccctgtgcgccctgttctgcaaggcgagcaatcacttgcgcataataagcgcgtgacgcttcggtaaattgccccagacacagttcttcaaaaataatctgattaattttcgcccgttcatccgcttcaggaataagacagttgatggaaaattgttccgtcagccgcccgcgataaaaatcctgttccatggtgtaacgtgtacccagcagcgccacacgagtcattcctgccccggtaattgcacgtccagtggcatccgctatgtgtaagaaaggcagagagcaacgagactcaatggcatccgccactttatgcatcgtattggtgcataacacaataccttctgcgcccgcccgctgtaagccaagcgccgcctcagccagaatatccccggttttgtcccactcaccgcgacgctggcactcttctatttcatgaaaatcgacgctatgtagcagcacttgcgcagagtgaagcccaccaagccgctgtttaatgccttcatttatcagacgatagtaaggaatagtggattcccagctcattcctcccagcaaaccaattgttttcattcctctctcctgatgtgtgttaccgcaacaaggctgaataaggaacgagacaaacgcctcaacggccaggtgcccaatctctattaacgaaaaaagggccggatgtacagcacatccggcccgtgaaatcagacgccgatatttctcaacttttcgcctgccatcagtttgcgctcgatatgttccagcgtgacatttttggtttccggaatgagccagaaagtgatgcccacaaacgcaatgttcagcgcagtgtagagccagaacgtaccggcagcgccaatgctatcaagcagtgtcaggaaggtcgcgccgataatcatattcgacacccagtttgtcgtcgttgagcaggtgatgccaaaatcgcggcatttcagcggctgaatttcagagcacaagatccacaccactggcgcggcgctcatcgcataaccggcaatacacatcatcgtcatgccaacagagagccaggacaagccactggaagccgtaccgttatcaaactgcatcaggcagtaacccagcaccagagtgcctaacgccatcacgctgaaaccaattttcagagccggcttacgccctgctttatctaccgtaaagaccgcaatgaaggtagcgaacataaaggtcagccccacgaccagagtcgcaatcatctgttgttctgtggtcgtaaagcccgccattttgaagatacgtggcgcgtagtacatgatgatgttcataccggtaaactgctgcatcgcctgcaacaacataccgagaaatacagcacgacggacgttacggttgatcttaaacagtgcccaaccgccctgttttaacttcaggctttcacgaatttcgttgagttcttctcgcgctttttccgacgtatcgcgcagcatacgcaacacttcttccgcctcaatatgacgccccttttccgccagccagcgcgggctatttggcaggaagaccaccagaataatcagcaggactgctggtaaagcaagaacccccaacattgcgcgccagttaccgctataactgaacgctgtatcggataaaaacgccagcacgatgccgagtgtgaccatcaactggtacatgctgatcatcttaccgcgaacgttttcacttgccatttcagaaagatatagaggagcggtgtaagacgcgatcccaacagcaatgcccaacaccacacgagcggcgattaacatctctacgctggtcgcaaaagcggaccctatcgaaccgagtacaaacaggatggcccccgccatcaggctgtatttacgccccaggcggaacgacagccacccattaaacagcgcaccaattgctgcgccgagcatcatgctactgaccacccattcctgcaaacggctggtcagcacaaagtgatcggtaatgaacggcaacgctccggcgattacgccgatatcaagaccaaataacaatcctgcgaccgcagcagctaccgaaacaaacatattcatacgccgcgtatcccgcagaggacgtggcgttaaagcagattccgtattgatagtaaccattttttcctgccagcagagagtaagacatagtgaaaaaatacgtgaacaattcacacaggtgtcaggtcggaaatagcataaatatggattaaattgctacgacatgtcgttatgtgatggatattccaattttcaaattaagttgaattattgagattattattaactacctaattttaaagcagataaaattcataaagttcattaattgataattgatatggattatttcataaccatgatatggattatgatgatctacaggtataaaaaaccctgccatgcggcagggtcataaaagtaagaggaatgaattaacgcgccagccaaccgccatccacagcaatggtataaccatttacataatctgaagcgctggaggcaagaaacactaccggccccatcaggtcactcggcagtccccaacggccagctggaatgcggtcgagaatttccgcgctacgttgttcatctgcccgcagttgttgagtattgttggtcgccatgtaacccggagctatcgcattaacattaatgttgtgtttagcccattcattcgccatcaatcgcgtcacgcccatcacgccgctttttgatgcggtataagaaggcacacggatcccgccctggaaggagagcattgacgcgatattgataatcttgccgccattgccttgcgcgataaagtgtttcgccgctgcctgagacatgaagaatacgctcttgatattcaggttcatgacatcgtcccagtctttttcgctgaattcgagagcgtcttcgcggcgaatcaatccggcgttattcaccaggatatcaatatgaccaaactcagctaccgcgcgatccagcagtgctggaatgccatcaatctttcgcagatcggcggtcaggcttaaaaaacgacgccccagcgccgtgacctgcttgatggtttcagtcggttcaacgatgttaatgccaacaatgtcacagcccgcttgcgccagccccaacgccatcccctggcccagcccagtatcacaaccagtgacgaccgcaactttaccttcgagagaaaatgcacttaaaatcataacaataccttattcgtttatgcccacaactagcgcaaatctttaacggccacatggtccatatcatcaaaaacctggttttcaccgaccatgccccagataaaggtataagctttggttccgacgccggaatggatcgaccagctcggggagatcaccgcctgctcgttatgcatcacaatgtgacgcgtttcttgcggttgccccatcatgtggaaaacgcaggcgtcatcatccatattgaaatagaaataaacttccatccggcgctcgtgggtgtgacacggcatggtgttccacaagttacctggagccagctccgtcagccccatactcaattggcaggtttccagcacatccgggacaaaatatttgttaatcgtgcgacggttactggtgaggttatcgcctaacgtgactggagatacttcgtccggtgtgacttttttggtgggatacgtcgtatgcgcgggtgcgcaattgtaataaaacttcgccggagtggcggtatcaatactggcaaagacaacttcttttgcacctttaccaacatacagggcgtcgcggtgaccgatttcatagcattgaccatcgacagtaatcgtaccggcaccgccaatattgataacacctaactcgcgacgttcaaggaaatagcttacgccgagttgtttaccaacttccccgccaacggaaaccgttttagttaccggcataatgccgccaacaataatacggtcaatgtggctgtaaaccatggtgtactcatcggcgacaaataccttttcaaccaaaaattcattgcgcagcccctgggtatccagcgtttttgcgtgcgcactgtggatgctctgtcttacgtccacatcaacctccgataatcagtgaagcgtgaaaatagaaaacaacaatgaaacactgtttcgttttctctatgaggggatgatatgcccatgggatagggttttcaattaaaaataaaacaatgtttcattttcaagttaaggattaaaaaaagtgcagtgtcgatcacgaatatgtcatgagaatggaaaaatcagggagccctgaaaaggtatgtcgactcaccagccatcattattcaacagattaatgacggcagatatttatcggtaaggaggaaatgcagagctactcgtcacgttcaatggtcaatgccacaccctggcctccgccgatacaaagcgttgccagtcctttgcgggcattacgtttcaccatttcatgaacaagagaaaccaggattcggcaaccggaagcgcctatcgggtgaccgagtgcgatcgcaccaccattaacattgacccgacgctcatcccattcaagcatcttgccaaccgaaagcgcctgtgcagcaaacgcttcattagcctcgataagatcgacatcagccaactgccagccaacacgctccaggcaacggcgggtcgcatacaccggagcaattcccatcaatgccggatccacaccaacgctggcaaatgcgcggatgcgggccagcacgggtaaattcaacgctcgtgctttggcttcgctcatcatcattactgcagctgccccatcgtttatggatgatgcattacccgctgtcacagaaccgagactatcaaatgaaggatttaaacgggctaagccttctgcgctggtgtcagtgcgtggctgttcatcggtatcaacaaccaacgtctgaccgttactttgggttattaccgggacgatctcatctttaaatcgtccggcgtcaatcgccgctcgcgctttttgttgcgagctaagtgcgtaagcatcctgcaactgacggctgatgccatattcgcgagccagattttcggcggtgacaccaatatgataatcattgaaggcatcccacaacccatcatgcacaagactatcaaccaactggctattgccaagctgtgcgccggtgcggctatcagtcagaacatgtggtgcgcggctcatgttttcctggccaccggcgatgacaatatcagcctcgccacactgtatcgcctgagtagccagatgcagtgctttaagcccggaaccacaaacgtcattaatagtgattgcagaaacgctattaggaagaccacctttaatagccgattgtcttgccggattctgccctgcccctgcagtcaacacctgaccaagaatcacttcatccaccgcatatgcaggaaccccggtacgttctattaacgctttgacgaccaggctgccaagttccacggcggaatgacccgctaacgcaccacgaaagcagccgataggtgtccgtaacgccccgacaatcacaacgtctttcatcacaacctcgcaccaattaacagtgcaatagtaaatgattgttaattacagttatcttaattgtttaaaaaaagtgactattatcacaaaggaaatacgcctgagtagtagtcagagacataactggcacgtaaggtttgcaaccactaacccaccaatagagaggtagataaggcgttaatctcccatacttaacctggtttatggtaaattgccctccattttgtttaatttgtagatgatacgttcagataatgtctaatatttggtcaaaagaagaaactctgtggagtttcgcgctctacggcacagccgttggtgcaggcacgctcttccttcctattcagttaggttcggcgggggctgtggtcctgtttattactgctctggtcgcctggcctttaacatattggccacataaagccttatgccagttcatcctctcatcgaaaacatcagcaggtgaagggataacgggcgcggtaacacactactatggcaagaagattggtaatctgattaccacgctgtacttcatcgccttttttgtcgtcgtgttgatatatgcagtggcaattaccaactcacttacagaacagctggcaaagcatatggttattgatcttcgcatccgtatgttggtgagtctgggggttgtattaatcctgaatctcatttttctgatgggacgccatgccactattcgggtaatgggatttttggtattcccattgattgcctatttcttatttctttctatttacctggtcggtagttggcaacctgatctattaacaacccaggtagagttcaatcagaatacccttcaccagatatggatatcgattcccgtgatggttttcgcttttagccatacgcccattatttctacgtttgccatagacagacgtgaaaaatatggcgaacacgctatggataaatgcaaaaaaattatgaaagtcgcttatctcatcatctgcataagtgtattgttctttgtctttagctgcctgctttctattccaccttcgtatattgaagcggctaaagaagaaggggttaccattttatcggcgctttctatgctgccgaacgccccagcatggttgtcaatttccgggattattgtcgcagtagttgcgatgtcgaaatcattcctgggtacgtactttggcgttattgaaggtgccacagaggttgtcaaaacaacattacagcaggttggtgtaaagaaaagtcgtgcatttaaccgcgcactatcaattatgttggtatcgctgattaccttcattgtttgttgcattaacccgaacgcgatttcgatgatttacgcgatcagcggcccactcattgccatgatacttttcatcatgcctacgctgtcaacgtatctcatcccggcgcttaaaccctggcgttccatcggaaatctgattacgctgatcgtgggtatcctgtgcgtatcggtaatgttctttagctaatatccgttgtggatggttcaaaattgcttcaattttgaaccatcccagttttcataatgttcatttgttattattccgctctatcacttctctcgtaatattatataattatcagccagttaaacacacaaagagttctgaacatcttaaataagactatttaagatacatgacgattgcattgcgtaaacgctttttatttacaaaaaaatggggaagtattacggcgattgcgaaaagtctgaagcgcttgaattaagataatatagaaaatcagatacaacaaaaatggcaggtagatgatgtgaagataaattggagcgggcgaagggaatcgaaccctcgtatagagcttgggaagctctcgttctaccattgaactacgcccgcttcgagatgcgtaaggcattataaaccttacgctctccttagcaagtaccacgctgctgactgctgattaattcgccatcagcattttggcttgctgccctgaggcggcaagtaacgtagcggatcaattgccgttgcacggtaacgaatctggaaatgcaagcgaacagatgccgcatcagtgctccccatggtagcgattttttgcccagccttcacgctttgcccattatttaccagcatcgtgtcattatgagcgtaagccgtaatgtaatcttcactgtgtttaatcatgatgagattaccgtagccacgcagctggttgcccacatacaccacctttcctgcacccgcggcgtaaataggtgtaccccgtggagctgagatatcaatccctttattgccgccatctgctgtcgaatacggcatgataactttccctgtcgttggccataaccaacaacgttgccctactggcggccaggaagatttcggtaccgctgatgacggtgtaaccgatgcggttttggtcgttgatttggcggttgatttacgtgtactactgctacttttcgccccacccagttttagtttctgacctacttcaatggtgtaagggggggaaatgccgttcagtcgcgccagttcttttacgctggttcccgtggtgcgcgaaatacgatatagcgtatccccccgtttcacggtgtaaacggagccggaatacgttcctgtatcggatgatttgctacccgaacagcccgccaaaagcagtccaaccgataacaacatcacgatacccagagattttttattcaggcgtcccgcactcaaaatctttcctcgcttaaaaaacaagacgccatatcatagcagccggcttctggatacccaatctcttgcttctggaaaaacgatgtaatagagaaagaggttaatttcatttggcaaagggaagtatcatcagcaaaatatttgctgtagtggtatcgaagttcctgacttttaccctatttcccaccttgatgcgtaataatcctaatttatcacattgattttatcgccactcatattgatacgtatcactgtccctattcagagtcctgtttcgtatcatatctgtgtttttttaacgtcatcacacttccttcctccccgaacgcttatcgtcgtttctggcgtaaatcttgcctgcttagactaaatctttgccataagaaccaaatgttcaaatcgagaggatttctatggaagcgcgggaagcaaccgctacgggtgaatcatgcatgcgcgtcgatgccattgctaaggtcaccgggcgagcacgatatactgacgattatgttatggcgggcatgtgttacgcgaaatatgtacgtagccctatcgcacatggttatgccgtaagtattaatgatgaacaagccaggagtttgccgggcgtcctggcgatttttacctgggaagatgtgccagaaatcccattcgccacggcagggcatgcctggacacttgacgaaaacaagcgcgatactgccgatcgtgccctgctaacgcgccatgttcgtcatcatggcgacgccgttgccatcgtcgtggcccgcgatgaactcacggcagaaaaagcggcgcaattggtcagcattgagtggcaagaattacccgttatcacctcgccagaagcggcgctggcagaagacgctgcaccaatccataacggtggcaatttactgaaacaaagcacgatgtcgacgggtaatgtccaacaaacaatcgatgccgccgactaccaggtacaggggcactatcagactcccgttattcaacattgtcatatggaaagcgtgacatcgctggcatggatggaggatgactcgcgaattaccatcgtttccagcacccagatcccgcacattgttcgccgcgtggttggtcaggcgctggatattccctggtcatgcgtacgagtcatcaaaccgtttatcggtggcggttttggtaataaacaggatgtactggaagagccaatggcagcattcctgaccagcaaacttggcggcattccggtgaaagtttcccttagccgtgaagagtgtttcctcgcaacccgtacccgccacgcttttactattgacgggcaaatgggcgtgaaccgcgacggaacattgaaaggttatagtctggatgttctgtctaacaccggcgcttatgcatctcacgggcactccattgcttctgctggggggaataaagtcgcttacctttatcctcgttgtgcctacgcttacagttcaaagacctgctataccaacctcccctcggctggtgcgatgcgtggttatggcgcgccacaagtcgtatttgccgttgagtctatgcttgatgatgccgcgacagcgttaggtattgatcctgttgaaattcgtttacgcaacgccgcccgcgaaggagatgctaatccgctcacgggaaaacgtatttacagcgcagggttgccggagtgtcttgaaaaaggccggaaaatctttgaatgggaaaaacgccgtgcagagtgccagaaccagcaaggcaatttacgtcgtggcgttggcgtcgcctgttttagctacacctctaacacctggcctgtcggcgtagaaatagcaggcgcgcgcctgttgatgaatcaggatggaaccatcaacgtgcaaagcggcgcgacggaaatcggccagggtgccgacaccgtgttctcgcaaatggtggcagaaaccgtgggagttccggtcagcgatgtccgcgtaatttcgacacaagacaccgacgttacaccattcgaccccggcgcatttgcctcacgtcagagctatgttgccgcgcctgcgctgcgcagtgcggcactgttattaaaagagaaaatcatcgctcacgccgcagtcatgctacatcagtcagcgatgaatctgaccctgataaaaggccatatcgtgctggttgaacgaccggaagagccgttaatgtcgttaaaagatttggcgatggacgctttctaccaccctgaacgcggcgggcagctctctgccgaaagctccatcaaaaccaccactaacccacctgcgtttggctgtacctttgttgatctgacggtcgatattgcactgtgtaaagtcaccatcaaccgcatcctcaacgttcatgattcgggccatattcttaatccgctgctggcagaaggtcaggtacacggcggaatgggaatgggcattggctgggcgctatttgaagagatgatcatcgatgcgaaaagcggcgtggtccgtaaccccaatctgctggattacaaaatgccgaccatgccggatctgccacaactggaaagcgcgttcgtcgaaatcaatgagccgcaatccgcatacggacataagtcactgggtgagccacccataattcctgtagccgctgctattcgtaacgcggtgaagatggctaccggtgttgcaatcaatacactgccgctaacgccaaaacgattatatgaagaattccatctggcaggattgatttgaggataacatcatgtttgattttgcttcttaccatcgcgcaaccacccttgccgatgccatcaccctgctggctgacaatccgcaggccaaattgcttgccggtggcactgacgtactgatacagcttcaccatcacaatgaccgctatcgccatattgttgatatccacaatctggcagagctgcggggaataacacaggcggaagatggcgcgctgcgaatcggctccgcgacaacatttactcagctcattgaagatcccgtaatccaacgcaatctcccggcgttatgtgctgcggctgcatcaatcgccgggccgcagatccgtaatgtcgccacctacggcggaaatatttgcaacggtgccaccagcgcagattctgccacgccaacgctaatttatgacgcgaaactggagctccactccccacgcggtgttcgtttcgtcccgattaatggctttcacaccgggccgggcaaagtgtctcttgagcatgacgaaatccttgtcgcctttcattttccgccacagccgaaagaacacgcgggcagcgcacattttaaatatgccatgcgcgacgcaatggatatttcaacaattggctgcgccgcacattgccgactggataacggcaatttcagcgaattacgcctggcatttggtgttgccgcgccaacgccgattcgctgccaacatgccgaacagactgcacaaaatgcgccattaaacctgcaaacgctggaagccatcagcgaatcagtcctgcaagatgtcgccccgcgttcttcatggcgggccagtaaagagtttcgtctgcatctcatccagacgatgacccaaaaagtgattagcgaagccgtcgccgcggcggggggaaaattgcaatgaatcacagcgaaacaattaccatcgaatgcaccattaacgggatgccttttcagcttcacgccgcgccaggaatgccgctttcggaactactccgagaacaagggcttcttagtgtcaaacaaggttgctgcgtaggcgaatgcggtgcctgtacggtgctggtcgacggcacagcaatagacagttgcttattccttgcggcctgggctgaaggaaaagagatccgcacgctggaaggtgaagcgaaaggtggaaaactttctcatgttcaactggcttatgcgaaatccggcgcagtgcaatgcgggttttgtacgccgggcctgattatggctaccacggcgatgctggcaaaaccacgcgaaaaaccattaaccattacggaaattcgtcgtggactggcgggaaatctttgtcgctgcacggggtatcagatgattgtaaatacagttctggattgcgagaaaacgaagtaaaaggatatccggcctgaattcaggccggattctcagaggttatgtgtttaacaactcatatttcttaatcttgcgatagagcgtagcaatgccgatgcccagttcatcagcaacttccttcttgctgttatgacgtgaaagcgcctcgcggatcatttgcttttccatctcctccagcgccgtgccgcccgcatcatcgagtgacaggtgcgcctcactgacctctgttacatcactttgctccgttgtgccattattcagcagatttggcggcaatagcgtgctgtcgataacttcacctgaaggaacaacgttaaccagatattccatcaaattgcttaactcgcgcaggtttccgggccaacgatgcttacgcaatatttcgacgacatcaggagcaatgccaggataaaccgatcccagacgacgggtatgcagatgtaaaaagtaatgcaccagtaattcaatatcttcctgacgttcacgcagcggtggaagagttatcgggataacattaagtcggtagaagagatcttcgcggaatttaccttcggcaatgaactgggccaaattctgattagttgcagaaatgatgcggatgtcgacttgtattgggctactggcaccaatcggcagaatttcacgcgcctcaatagcgcgcagtaatttagcctgcaacattaatggcatatcaccaatttcatcgagaaacagcgtgcccgtattcgccgcctgaatcaaccctgttttaccgttggcagaagcgccagtaaatgcgcctttaacataaccgaacagttcgctctccagaagctgttccggaatcgcggcacagttgatagcaataaagggtttattccgtcttccgctcaacttatggattgcacgggcgacgacttctttacccgtgccgctttcaccaaccaccataacgctggatgggctgggtgcaatacggctaatgagtcgttttaattgccgcataacacggcactcgccaaccaattgttcaatatgcggttcatcaggtgcatttgctacagaaaaactggtatgcgattggtgaaacgccattaaaaatagttgtcggccctggatgttatgcaactgaccaatgattaattcacttttatcatcccacgaaacaatatgttgcatatgaccatgggtaaaattactctcaaatgttaatggtctgaaacgaacaggttttccaataatattattttgtacaacaccgagtgtttttaaagctgtctgattaacaaactgaacccgattatcagcatcaaccactaacacgccctgatccatattatcgatcatggtcgcgaatattttactgatgttatctcctggtccctgatcctccagaagtttagaaacaaaaatggtggatatatggcgaacgtaatcggaaaattcgcgtaaattatcactgatatgttcttgttgctcgtgggtaacggcaatcaaacttatcaccccaacacaacgttcctgtaaaatgacaggcgtacccagaaatgctttttcgcggcaattttctttactatcgcaaccttcacaaaggggatcgaagcgagactgtgtcacaactttttcagttttcgtttccaggacgtggcggagcaggcgtgagttgccgctcaactggcggccaagaaacttcccatacgcgcccgttccggcgacgcgacacaagttttcatcaacgatctcaacctcaagctgcaaaacgctggcaagcattctggcaaaacgctgaattgtcggttgaatttgcatcaatactgactgcgtagtcgcaagctccatagctttaccttccagacttacttaaaagtcgatcattgaagacgttgatggttcacagatcatgatgatattaactcaggcgaaattggctttgataaaaacataagatttttatcactttctaataaaattatggaagagatatcacatttctatatcaatatgagaattacagcggcaagtttatcaaactgaagagagatagcctgcctctttatcttatttctgatacttagcagcaaataaataacgtgataaaaaaagccaaacgttttcgtattttaaaaacaaccggaaactggcatcaatatgtgatcaaccccacacattatccgtcaaattagcctttcgcagccgcgtggataattctggcacacttattgttagtcccaggtatagctgtgaaaacaccaatcactttggcacgtcacagtgaaataaaccactttgcctgtcattccactatcgggactttatgatgaaaactgttaatgagctgattaaggatatcaattcgctgacctctcacctgcatgaaaaagattttttgttaacgtgggaacagacgccagacgaactgaaacaagtactggacgttgccgccgcgttaaaagcactgcgtgctgaaaacatctcaaccaaagtctttaatagtggattaggtatttccgtattccgcgacaattccacccgtacccgcttctcttatgcttccgcgcttaacctgctcggccttgcacaacaagatcttgacgaaggaaaatcacaaatcgctcacggcgaaaccgtgcgtgaaaccgccaatatgatctccttctgcgctgacgctatcggtattcgcgacgatatgtatctgggcgcaggcaacgcctatatgcgtgaagttggcgcggcacttgatgacggctacaaacaaggggttctgccacagcgtccggctttagtgaacctgcaatgcgatattgaccacccgactcaatcaatggctgatctggcatggttacgtgaacactttggttcactggaaaacctgaaaggtaaaaaaatcgccatgacctgggcctactccccaagctatggcaaaccgctctctgtaccacaaggcatcatcggtctgatgacccgcttcggtatggatgtcaccctggcccatccggaaggctacgacctgatcccggatgtcgttgaagttgctaaaaacaatgctaaagcctccggtggtagcttccgtcaggtcaccagcatggaagaagccttcaaagacgcagacatcgtttatccgaagtcatgggcaccttacaaagtgatggaagagcgtactgaattgctgcgtgcgaacgatcacgaaggcttaaaagcactggaaaaacagtgtctggcacagaacgcgcaacacaaagactggcattgtactgaagagatgatggaactgacccgtgatggcgaagccctgtacatgcactgcctgccagctgatatcagcggcgtatcctgcaaagaaggtgaagtgactgaaggcgtattcgaaaaataccgtatcgctacctacaaagaagccagctggaagccttatatcatcgccgcgatgatcctgtcccgtaaatacgccaaaccaggtgcactgctcgagcaactgctgaaagaagcgcaagaacgcgtgaaataacccctcgggccgatcagctggtcggccctctatttccagaggccaaaaggataggatatgtccgttttctcattgaagattgatatcgccgataacaaatttttcaacggcgaaacatcaccgcttttttcgcaaagccaggcaaaactggcacgccagttccaccagaaaattgctggttatcacccaacaccgctttgtgcgctggacgatctcgcaaacctgtttggtgtaaagaaaattctcgtcaaagacgaatcaaaacgattcggtctgaacgccttcaaaatgctcggcggtgcgtacgccatcgctcaattattgtgtgaaaaatatcatcttgatatcgaaacgctgtcatttgagcacctgaaaaatgccatcggcgaaaaaatgactttcgcgactaccaccgacggcaaccacgggcgcggtgtggcatgggcagcacagcaactcggacagaatgcggtgatttacatgccgaaaggttctgctcaggaacgcgttgacgccattctaaacctcggtgccgagtgcatcgtcacggatatgaactatgacgataccgttcgcctgaccatgcaacacgcgcagcagcacggctgggaagtggtacaggacacggcatgggaaggttacaccaaaatcccaacctggatcatgcaaggctacgcaacactggcggatgaagccgtcgagcaaatgcgtgaaatgggcgtcaccccgacacacgttctgctgcaagccggtgtcggtgcaatggccggtggtgtgctgggttatctggtcgacgtctatagcccgcaaaatctgcacagcattattgttgaacctgacaaagctgactgtatttatcgctccggcgtcaaaggcgacatcgtcaacgttggcggtgatatggccaccatcatggcgggcctggcctgcggcgaacctaacccactgggctgggaaatcctacgtaactgcgccacccaattcatctcctgccaggacagcgttgccgcattaggtatgcgcgtgctgggtaatccgtatggcaacgacccgcgcatcatctccggtgaatccggcgctgtcggtttgggcgttctcgcagcggttcattatcacccgcaacgtcaaagcctgatggaaaaactggcgctgaacaaagatgccgtggtgctggttatcagcactgaaggcgacaccgacgtgaagcactaccgcgaagttgtctgggaaggcaaacacgctgtagcaccttaatcaccctattggaactgctccctgcaaaacggggagtaaaaaatctggagaaaaataatggctaagaatattccattcaaactgattcttgaaaaagcaaaagattaccaggcagacatgactcgcttcctgcgcgatatggttgctattcccagtgaaagctgcgacgagaaacgcgtagtacatcgtattaaagaagagatggaaaaagtcggcttcgataaagttgaaatcgacccaatgggcaatgttctcggttatatcggccacggcccgcgtctggtggcaatggacgctcatatcgatacagtcggcattggcaacatcaaaaactgggacttcgatccgtatgaaggcatggaaaccgacgagctgatcggtggtcgtggtacttccgaccaggaaggcggcatggcgtctatggtatatgccggaaaaatcattaaagatctcggtctggaagatgaatataccctgctggtcaccggtactgtgcaggaagaagactgcgacggtctgtgctggcaatacattattgaacaatccggcattcgcccggaatttgtggtcagtaccgaaccaaccgactgccaggtataccgtggtcaacgcggtcgtatggaaattcgcattgatgttcagggtgttagctgccacggttcggcaccagaacgtggtgataacgccattttcaaaatgggtccaattcttggcgaattacaagaactctcccaacgtctgggttatgacgaattcctcggcaaaggcaccctcaccgtttctgaaattttcttcacctccccaagccgttgcgctgtcgcagacagctgcgcagtttcaatcgaccgtcgtctgacctggggcgaaacctgggaaggcgcgctggacgagatccgcgccctgcctgcagtacagaaagctaacgcggttgtttctatgtacaactacgaccgcccatcctggactggcctggtttacccaaccgaatgctacttcccgacctggaaagtggaagaagatcacttcaccgttaaagcactggtgaatgcttatgaagggctgtttggtaaagcgcctgtcgttgataagtggaccttctcaactaacggcgtatccatcatgggtcgccacggcattccggtcatcggttttggccctggtaaagaaccggaagcgcacgcgccaaacgaaaaaacctggaaatctcacctggtaacctgtgccgctatgtacgctgcaatcccattaagctggctggcaaccgaataattactcttcacttatccccctccggttcgccggagggtttttggagtttgctatgcgcgtattgataaaaaacggcattgttgttaatgcagatggacaggcgaagcaggatttgctgattgaaagcgggattgttcgccagttgggtaccgatatttcgccgcaactcccttgcgaagaaattgatgcctctggctgttacgttttccctggcggcgtggatgtccatacgcatttcaatattgatgtcggcatcgcgcgcagttgtgatgatttttttaccggtacccgcgctgctgcgtgtggcggtacaacaaccattattgaccatatgggatttggcccaaatggctgccggttacgccatcaactggaagtttatcgcggttatgccgcccacaaagcagtcatcgactacagctttcacggtgtcattcaacatattaatcacgctatcctcgacgaaattccgatgatggttgaggaaggactgagcagttttaaactctatttaacctatcaatataaactcaacgatgatgaagtgttgcaggcattacgccgcttgcatgagtccggcgcgctgaccaccgtacacccggaaaatgacgcagctatcgccagcaagcgggcggagtttatcgccgcagggttaaccgcgccgcgttatcatgccttgagtcgacctctggaatgcgaagcggaagccatcgcccgcatgattaacctggcacaaattgccggtaacgccccgctctatatcgtgcacctgtctaacggcttaggtctggattatctgcgtcttgcccgtgcgaatcaccagccagtctgggttgaaacctgcccacaatatctcctgttggacgaacgcagttacgatacagaagatggcatgaagttcattcttagcccaccgctgcgtaacgtacgcgagcaggacaaactgtggtgtggcatcagcgatggtgcgattgacgtggtggcaaccgatcactgcaccttctcgatggctcaacgcctgcaaatttctaaaggcgatttcagccgctgcccaaatggcttacccggtgtggagaaccgcatgcaactgctgttctccagtggcgtgatgacgggacgtatctcactggagcgttttgttgagttaaccagtgcaatgcccgccaggctgtttggcctgtggccgcaaaaagggatattagcgcccggttccgatggtgacgtggtgattatcgacccacgtcagagccaacaaattcagcatcgccatctccacgacaacgccgactactcgccctgggaggggtttacctgtcagggcgcgattgtcagaacattatcccgtggtgaaacgattttctgcgacggcacctttacaggcaaagccgggcgaggtcgtttcctgcgacgcaaaccgtttgtccctcccgtgctctaaccactgccagggatctatacacaatcaagaatgatgagtgaggaaaaatgagtaagaaaattgttctcgccctgggcgggaatgcgctgggcgatgacctggctgggcaaatgaaagcggtaaaaattacttctcaggcaattgttgatttaattgcccagggacatgaggtcatcgtcactcatggcaacgggccacaggtgggcatgattaaccaggcctttgaagctgcagcaaaaactgaagcgcactcgccaatgctgccgatgtctgtctgtgttgccttaagccagggttatattggttacgatctacaaaacgccttaagagaagaactgctttctcgtggcattaataaacctgtagcaacgctggttacccaggtcgaagtcgatgctaacgatccggcattcctcaacccgaccaagccgattggttcgttctttaccgagcaagaagcagagctactgacaaaacagggttacactctgaaagaagatgcgggtcgcggctatcgtcgtgtcgttgcttcgccaaaaccggttgatatcattgaaaaagaaacggttaaagctctggtagatgccggacaggtggtgatcaccgttggcggtggtggtatccctgttattcgtgaaggtaaccatctgcgtggtgccagcgcggttatcgataaagactgggccagcgcccgtttagcagaaatgatcgatgccgatatgctgatcattctgactgcggtagaaaaagtggccattaacttcggaaaagagaatgaacagtggctcgatcgcctgtcgttaagtgatgctgaacgctttatcgaagaaggtcattttgcgaaaggttctatgctgcctaaagtggaagctgccgcctcgtttgctcgctctcgcgcaggtcgtgaagcactgattaccgtattgagcaaagcgaaagaagggattgaaggcaaaaccggaacggtgatttgtcagtaatttaaaggccggatgggtaataccatccggccattttcatttaagccacttccagcacttcttttgtcgctttaacgccctgatgcatcaacatcattaacgcctcaagtacgccgccgccaatcgcccgggctttatcagaaacgctggtgaaatcagccgtttcaccacgaggatcgatatcaccaattttaaaaccaccgaccacggccagtccgtcgttcaacaagccacgcaccatccccgtcaacggtgctttaatttcatgctcaccaatccaggcaatgacatcgccctctttcaccagatcgcctaatttcacgttggatcgcataatgcctgcagcaggagcgcggatcactcgtcgggtggtatgccccataatattgccgggaacaccggtattctcctgcgcacaacctgagtaaatcacctgaccgagccagtgcccgcgatttgtttcaattaccgcatgacaatccttccctgcagtaaagcccggcccaagcgcgattgttactggtgccatatctgcccgcgttcccaaattctgtttcgccagaatagcgtccaccacgcaaagcggtttcagttcatcaagcaatgaacaggtgggatctaccatcacagggataaatccgcgttcggtaagtttcatcgcttccgcagagctggttgccaggcgggcggtgacgccttcgaccgtcatttcgccatcgaacacggcctgggcaaacgccacggtacaacgaatcactgtcggtttttccacttccaacatgatcactttaaaacccgcatgatacagacgtagcgctacaccactggcgatatcccccgcaccgcgaatcaccaccagctggtgtccggaaggatgagaaggcttcatcatcagcccacccggcgcgttatttttcacctgtaatatttctgccagcacgctgatggcgatctcctgcggcgtttccgcacctatgttgtaaccaacgggcgcatgtaaacgggcaatatgttcttcagccacgcctttctcacgcaattggcgcaggaaaagctgaaccttgcggcgacttgccagcaaccccagccatgcaatgggttgttcaatgagtttgtcgagggcttcacgatcctgattattcgtggcaatcaggacaaaattatcagggcgaatatccagtgcttccactgccgcaccaaacgactcagcatggagaagcgtggttgatggtgggaatagttcaggattgaggctttcgcgataaatatcagcaacggcgatatcaaatcctaatagcgccgcactctgggctatcgcccggttgacatgccccgcaccaatcaacaccagacgtggacgcataccatggacgctgataaatactgacattgcacctccacaatctgacccgacagcatccgcaccgttacgagccatacgtccatggaataatcgcggcttacgttcctgcaatgcctgaagcgactcttcaatcaccttccgttcaaccattccgccaccaattgtaccgacgatagaaccatcggcgcgcactaacatttgtgcagaatggcggggggttgagcctcggctatcaacaatttgcgccatcgcaaacggacaattttgctcttcgagttttgcagcctctgtgaaaatattcataccaacctcaatggatatcctttcagtaacccggaatacccgggccgctaattcacaaatctgcgcgcgattgcaggatgttcttgtatatcgcccagccagattgcctctacgttgtgttgttgcagcggttgaaggagctcgctttgcgcaatcgcattctcacattgagaaaaacggttaatgaaccagactcgccgacaaccttgcggtacgtttttaaacgccccctgagggtggcgaaccagcgcaacgagatcgctcagttgcaagggtgcatcaggtgttaacccagtaatatcagcaaactgcgaccagcgatggacattttctgtgctcactttcgcacccaaaatatgtcctcccatcacagcaatcacgcagcaactgcttttaggtatgcaaggttcgtgctcatcaggcgcttttaacggcattccacgcgagccatctgcctcaatgagaattacgtcacactctggtcgttgtaccagtgcatcaatcgcttctggcgtaaatccctgcacttttccctggttcgctttccagcagtgaaaacaaaatgaaatgggggatataaaagacgcatgaggaagcatggcgggatcacgacagaaaaccacgggccagtgagatgttggcataaacatatgtgtcgtcgtagtgattaatacacgcctgccactcgcctggaacagttctgccagccaaaaaagcaagctggttttccccccagcaccaacaatagaaatcacagtgggacgtttctgcgcgcctaaatcaatgaataatgccgatgggtcaattatacttttcacgcgtctttatggacctctctgggataaattaccctcaacgtaatccatcaggaagtaacgcaattatcaggcgttattagctcctgtaaataatggaatcactatgtcagccatcgactgtataattaccgccgcaggattatcatcaagaatggggcaatggaaaatgatgttaccctggcaacagggaacaattcttgatacaagtatcaaaaatgcgttgcagttttgtagccgaattattttagtcaccggctatcgtggtaatgaactgcacgagcgttatgcgaaccagagcaatatcactattatccacaacccagattatgcgcagggtttactgacatcagtaaaggccgcagtacccgcggtgcaaacagaacattgttttctcacccacggagatatgccaaccctcaccatcgatatttttagaaaaatctggtcgttacgaaatgatggcgcaatactgccactccataatggcatccccggccatccgattttagtgtcaaaaccatgcctgatgcaggcaatccagcgacccaatgtcaccaatatgcgtcaggcactccttatgggagaacattattccgtcgaaatagaaaatgcagaaataattttagatattgatactccggacgactttattacagcgaagaaaaggtatactgaaatttagaaaacgtagttaaacgattgcgttcaaatatctaatccctccagcactctttatcataatgataaggaatcactgattttgagaaaagagaaaatgtgataaatgggctggcaataataattttcaggagtgattttaattctcatttggcacctgtgagttcattcacaaaaagccattaagtttcgagccgcctcacatttttttatatttcccgccaaacctggcaagagtggtgcgattgttgctctatccccctaaaccaccggatttctcaacaccggtcactcaatgatatctgtataagctaaggagagggttatgggggatattatgcgtcccattccgtttgaggaacttttgacgcgcatatttgatgaataccaacaacaacgctcaatctttggtattcccgagcaacagttttactcacccgtaaaaggtaaaactgttagcgtcttcggtgaaacctgtgccactcccgtcggccctgccgctggcccgcacacgcaacttgcgcaaaacatcgtcacctcctggctgactggcggacgcttcatcgaactaaaaaccgtccaaattcttgaccgcctggagctggaaaagccctgtatcgatgccgaagacgagtgctttaacaccgaatggtctaccgaatttaccctgcttaaagcctgggatgaatacctcaaagcctggtttgccctgcaccttctcgaagcgatgttccagccttctgattccggtaaatcgttcatctttaatatgagcgtcggttacaacctcgaaggtattaagcaaccgccgatgcagcagttcatcgacaatatgatggacgcatctgaccatccgaaattcgctcaataccgcgatgcacttaataagctactccaggatgaggcatttttagcccgccacggattgcaggaaaaacgcgaaagcttgcaagccttacccgctcgcatccccaccagcatggtacaaggggttaccctctccaccatgcacggctgtcctccgcatgaaatcgaagccatttgccgctacatgctggaagaaaaagggctcaacacctttgtgaaactcaacccgaccttactggggtacgcgcgtgttcgtgagatcctcgatgtctgcggtttcggttacatcggcttaaaagaagagtcatttgatcacgacctcaagctgacgcaagcactggaaatgctggaacgcctgatggcactggcaaaagaaaaatcactcggctttggcgtaaaactgactaacactctcggcaccatcaacaataaaggcgcattgcccggtgaagagatgtatatgtcaggccgtgcgctgttcccgctctccatcaacgttgcagcagttctctctcgcgcctttgacggcaaactgcccatttcttattccggtggtgccagtcagctgactatccgcgatatttttgatactggtattcgccctattactatggcaaccgacctgctgaaacctggcggctatctgcgcttaagtgcctgcatgcgcgagctggaaggctccgacgcctggggacttgaccacgttgacgtcgaacgactgaacagactggcagcagacgcgttaaccatggaatacacccagaaacactggaagccagaagagcgtattgaagtggctgaagacctgccgctgaccgattgctacgttgccccctgtgttactgcctgcgctatcaagcaagatattccggaatacatccgtttgcttggcgaacaccgctatgccgacgcgctggaactcatctatcaacgcaacgccctgcccgccattaccggtcatatttgcgatcaccagtgccaatacaactgtacccgcctggattacgacagtgcgctgaatatccgcgaactgaaaaaagtcgccctggaaaaaggttgggatgaatataagcaacgctggcacaaaccagccggttccggttcacgccatccggtagccgtgattggtgcaggtccggcaggtctggcggcaggttacttccttgccagagcgggccatccggttacgctgtttgaacgagaagccaatgcgggcggcgtggtgaaaaatatcattcctcagttccgtattcctgcagagttaattcagcacgatatcgattttgttgccgatcacggcgtgaaatttgagtacggttgctcaccggatctgaccgtcgaacagttaaaaaatcagggcttccactatgttctgattgccaccggcactgataaaaatagcggtgtgaaactggcgggcgacaaccaaaatgtctggaaatcactccccttcctgcgtgaatacaacaagggcacagcgctcaagctgggcaaacatgtggtcgttgtcggggcgggtaacacggcaatggactgcgctcgtgcggcgttacgcgttccaggcgtagaaaaagcaacggtcgtttaccgtcgttcactgcaagagatgccagcatggcgcgaagagtatgaagaagcgttgcacgacggcgtggagttccgtttcctgaataatccggaacgtttcgatgctgatggcaccttaaccttgcgcgttatgtcgcttggcgaacctgatgagaaaggtcgtcgccgtccggttgaaaccaacgaaacagtaacactgcatgtagacagcctgatcaccgccattggtgaacagcaggatactgaagccctgaatgcgatgggcgtgccgctggacaaaaacggctggccagacgtcgaccataatggcgaaacgcgtctgagtgacgtctttatgatcggcgacgtacagcgcggaccatcctccattgtcgctgctgtcggaaccgcgcgtcgggcgaccgatgccatcctgagtcgggaaaatatccgttcccaccagaacgataaatactggaataacgtcaatccggcggaaatctatcaacgtaaaggcgatatctctgtcactctggtgaacagtgacgatcgtgatgcgtttgtcgcgcaggaagccgctcgctgccttgaatgtaactacgtttgcagcaagtgtgtggatgtctgcccgaaccgcgccaacgtatccattgcggtcccaggcttccagaaccgtttccagacgctgcacctcgacgcttactgtaacgaatgtggcaactgcgcccaattctgcccgtggaacggtaaaccgtacaaagacaaaatcaccgtcttcagcctgtcgcaagactttgataacagcagcaacccaggcttccttgtggaagattgccgggtacgcgtacgtctgaataaccaaagctgggtgttaaacatcgacagcgaaggtcagttcaacaacgtaccaccggagctgaacgatatgtgccgcatcattagccatgtccaccagcatcatcattatctgctgggccgcgtggaggtgtaatcatgttgattctgaagaatgtcaccgcagtgcagttacacccggcgaaagtgcaggaaggcgttgatatcgccatcgaaaatgatgtgattgtcgctatcgacgatgccctgacgcaacgctatcccgatgccagctacaaagagatgcatggtcggattgtgatgccgggaattgtctgctcgcacaaccatttttactcggggctgtcccgcggaattatggcaaacatcgccccctgcccggatttcatctcaacgctgaaaaatctctggtggcgactcgatcgcgcccttgatgaagagtcgctctattacagcggactgatttgttccctggaagcgattaagagtggatgtacatcggttatcgatcaccatgcctctccggcgtatatcgacgggtcgctctccacattgcgcaacgcatttttaaaagttggcctgcgcgcgatgacctgttttgaaactactgaccgtaacaacggcatcaaagagttgcaggaaggtgtagaagaaaacatccgcttcgcccgtcagattgatgaggcgaagaaagcagcaaccgagccgtatctggtggaagctcatatcggcgctcacgcgccgtttaccgtgccggatgccggtctggagatgctgcgtgaagccgtgaaaagcacaggtcgtggtttgcatattcacgctgcggaagacctttacgacgtttcctacagtcaccattggtacggcaaagacctgctggcacgactggcgcaattcgatctcatcgacagcaaaacgctggtcgctcatgggctgtacttgtcgaaagatgacatcgccctactcaatcagcgcgatgcgttcctggtgcataacgcccgttcaaacatgaacaaccatgtcggctacaaccatcaccttagcgacatccgcaatctggcgttgggaacggacggcattggttcggacatgtttgaagagatgaaatttgccttctttaaacatcgcgatgcgggtggcccgctgtggcctgacagttttgccaaagcactggctaacggcaacgaactgatgagccgcaactttggcgcgaaatttgggcttctggaagccggttacaaagccgatttaaccatttgcgattacaactcgccgacgccgctgctggcagacaatatcgccgggcatatcgctttcggtatgggctcaggcagcgttcacagcgtgatggtcaatggtgtgatggtctatgaagaccgtcagtttaacttcgattgcgattccatttatgcgcaagccagaaaagccgctgccagtatgtggcgtcggatggatgcgctggcataaataacagctcccctcttctttcagagaagaggggaaattaaggaaagacgatgattgaacaatttttcagacccgactcagtcgaacaggcgctggaactgaagcgccgctaccaggatgaagccgtctggttcgccgggggcagcaaactcaacgctacaccaacccgtaccgataaaaagattgccatttccttgcaggatctggagctggactggattgactgggataacggtgcactacgaattggcgcaatgtctcgcttgcagccactgcgtgatgcgcgatttattcctgcagcactgtgtgaagccctcggttttgtttactcacgccatgttcgtaatcagtcgaccattggtggtgaaatcgccgcccggcaggaagagtcggtgctgcttcccgtcctgctggcactggatgctgaactggtttttggcaacggcgaaacgctgtcaatcgaggactacctggcctgcccatgcgatcgcctgttaaccgaaattatcattaaagatccgtatcgcacctgtgcgactcgcaaaattagccgttctcaggcaggtttaaccgtcgtgacggcagccgttgcaataacagaccacgacggtatgcgaattgcgctggatggcgtagccagtaaagcactgcgtctgcatgatgttgaaactcaaaatctggaaggcaatgcacttgaacaggctgtcgccaacgccattttcccgcaggaagatttgcggggcagcgtggcctataaacgctatatcacgggagttctggtagccgacctgtatgccgactgccaacaggctggggaggaagccgtatgatcatccactttactttaaatggcgcgcctcaggagctaaccgttaatccaggcgaaaacgtgcaaaagctgttgtttaacatgggaatgcactctgtacgcaacagtgatgatggttttgggtttgccggttctgacgcaattatctttaacggtaatatcgttaacgcgtccttgcttatcgccgcacagttagagaaggcagatattcgtaccgcagaatctctgggcaaatggaacgagttaagtctggttcaacaggccatggttgatgttggcgtggtgcagtctggttataacgatccagctgcggctctgattatcaccgatcttctcgatcgcatcgacgcacctacccgcgaagagatcgacgacgcgctctcaggtctgtttagccgcgatgctggctggcagcaatactatcaggtcattgaactggcggttgcacgtaaaaataatccgcaggccaccattgatatcgctccgactttccgtgacgaccttgaagtcattggcaagcattatcctaaaactgatgccgcgaaaatggtgcaggcaaaaccctgctatgttgaagaccgcgtaacggctgacgcctgcgtcattaaaatgttacgtagcccacacgctcacgcactgattactcatctggatgtcagcaaagctgaagccttaccgggcgtcgttcacgttattactcacctgaattgcccggatatttactataccccgggtggtcagagcgcaccggaaccatcaccgcttgaccgccgtatgttcggcaagaaaatgcgtcacgtcggcgatcgcgttgctgcggtagtagccgaaagtgaagacattgcgctcgaagcactgaagctcatcgatgttgaatatgaagtgcttaagccggtaatgtcgattgacgaggcaatggcggaagatgcgcctgtcgtgcacgatgaaccggtggtgtatgttgctggtgcgccagatactctggaagatgataacagccatgcagcccagcgcggcgagcatatgatcatcaacttcccgatcggttctcgcccacgcaaaaatatcgctgccagtattcatggtcatattggcgatatggacaaaggctttgccgatgccgatgtgatcattgagcgaacctataactcaacgcaggcgcagcagtgcccgactgaaacacatatctgctttacccgtatggacggcgatcgtctggtgatccacgcctccacccaggtaccatggcacttacgccgccaggtcgcgcgcctcgtgggcatgaaacaacataaagttcatgtcattaaagaacgtgtaggcggcggttttggctctaaacaggacatcctgctggaagaagtgtgcgcctgggcaacttgcgtgaccgggcgtccggtacttttccgctacacccgtgaagaagagtttattgctaacacctctcgtcacgtagcgaaagtcaccgtcaaactgggcgcgaaaaaagatggtcgcctgacggcagtgaagatggatttccgcgccaacactggcccttacggtaaccactcactcaccgtaccgtgtaacggaccggcgctgtcgctgccgttatatccatgcgataacgtcgatttccaggtcaccacctactacagcaacatttgcccaaatggtgcttatcagggttatggcgcaccgaaaggtaacttcgctatcaccatggcattagcggaactggctgaacagttacagatcgaccaactggaaattatcgaacgtaaccgggtacacgaagggcaagagctgaaaattctcggtgcaatcggtgaaggtaaagcgccgacctccgttccttccgccgccagctgcgcactggaagagatcctgcgtcagggtcgcgagatgatccaatggtcttcaccaaaaccacaaaacggtgactggcacatcggtcgcggcgtcgccattatcatgcagaaatcagggatcccagatatcgatcaggctaactgcatgatcaaactggaatcagacggtacctttatcgttcattctggcggtgcggatattggtactggcctggatactgtggtgacgaaactggcagcagaagtgctgcactgccccccgcaggacgtgcatgttatctccggtgataccgatcatgcgttgtttgataaaggcgcatatgcctcgtccggtacttgcttctcgggtaacgctgcgcgtttggcagcggaaaatctgcgggagaaaatcctgttccacggcgcgcaaatgttgggtgagccagtggcagatgttcaactagcaacgccgggcgtcgttcgcggcaagaaaggcgaagttagtttcggagagatagcccataaaggcgaaaccggcaccggctttggttcactggtgggaactggcagttatatcacgcctgatttcgccttcccgtatggcgcaaacttcgctgaagttgccgtcaacacgcgtacgggtgaaatccgcctggataaattctacgccttgctggactgcggtacaccggtcaatccagagttagcgctgggacaaatctacggtgccaccctgcgtgctatcggccacagtatgagcgaagagatcatttatgacgccgaaggtcacccgttaacgcgtgatttacgcagttacggcgcaccgaaaattggtgacattccgcgtgatttccgcgctgtgctggtgccgagcgacgataaagtcggcccattcggggcgaaatcgatctcggaaatcggtgtaaatggcgccgctccggcgattgctaccgcaattcacgatgcctgcggcatctggttacgcgaatggcatttcacaccggagaaaatactcaccgcgctggaaaaaatataagtaataaatggccgcttcggcggcctgtttctctgtttgaacgatgactaaatagtgactgcgaaaatgagataagccgttctcaaggcgtcctgcgccccaaattcgtgggaatttattttactaattcagatgatcaaatttactttaaaaggagtgaagggatgtctgatataaaccatgcaggttctgaccttatatttgaactggaggatcgccctccctttcatcaggctctcgtaggtgccattacccatctgttggcaattttcgttccgatggtaacccccgcgttaatcgtgggtgcggccttacagctttccgctgaaacaactgcctatcttgtttctatggcgatgatcgcctctggtattggtacctggttacaagtaaaccgctacggcatcgtcggttctggtttactttcaattcagtcagtcaatttttcatttgttacggtcatgattgcgctgggcagcagcatgaaaagcgacggttttcacgaagagttaatcatgtcgtcgctcctcggcgtctccttcgttggcgcatttctggttgtcggctcttcttttatcctgccctatttacgtcgggttattacgcctaccgtcagcggcattgtggtgctgatgatcggcttaagcctgattaaagtcggcattattgattttggtggaggatttgcagccaaaagcagcggtacgttcggcaattacgaacatctcggcgttggcttattggttttgattgtggtgatcggctttaactgctgccgcagtccgttgctacgcatgggtgggatcgccattgggctatgtgtcggctatatcgcatcgttatgcctgggcatggtggatttcagcagtatgcgcaatttgccgttaatcaccatcccgcatccgttcaaatacggctttagttttagcttccatcagttcctggtggttggcacgatttatctgcttagcgtgctggaagctgtcggcgatatcaccgccacggcaatggtttcccgccgtcccattcagggggaagagtatcagtcccgactgaaaggcggcgtgctggcagatggtctggtttctgttatcgcctccgctgtcggttcattaccattaaccacgtttgcgcaaaataatggggttattcagatgactggcgtcgcttcacgttatgtcgggcgaaccatcgcggtaatgctggttatcctcggcttatttccgatgattggcggcttttttacgaccattccctcggcagttctgggaggcgcaatgacgttgatgttttccatgattgccatcgcagggattcgcatcatcatcaccaacggtttaaagcgccgagaaacacttattgtcgccacttctttaggtttaggacttggcgtctcctacgatcccgaaatttttaaaatattgccagcctctatttatgtattagttgaaaaccctatttgtgctggcgggttaactgcgattttattaaatattatcctccctggtggctaccgacaggaaaacgttctgcctggtattacctcagcggaagagatggattaacagtaaaggagtcaatgatgtcaggagaacacacgttaaaagcggtacgaggcagttttattgatgtcacccgtacggtcgataacccggaagaaattgcctctgcgctgcggtttattgaggatggtttattactcattaaacagggaaaagtggaatggtttggcgaatgggaagacggaaagcatcaaattcctgacaccattcgcgtgcgcgactatcgcggcaaactgatagtaccgggctttatcgatacacatatccattatccgcaaagtgaaatggtgggggcctatggtgaacaattgctggagtggttgaataaacacaccttccctactgaacgtcgttatgaggatttagagtacgcccgcgagatgtcggcgttcttcatcaagcagcttttacgtaacggaaccaccacggcgctggtgtttggcactgttcatccacaatccgttgatgcgctgtttgaagccgccagtcatatcaatatgcgtatgattgccggtaaagtgatgatggaccgaaacgcaccggattatctgctcgacactgccgaaagcagctatcaccaaagcaaagaactgattgaacgctggcacaaaaatggtcgtctgttgtatgcgattacgccacgcttcgcccctacctcatctcctgaacagatggcgatggcgcaacgcctgaaagaagaatatccggatacatgggtacatacccatctctgtgaaaacaaagatgaaattgcctgggtgaaatcgctttatcctgaccatgatggttatcttgatgtttaccatcagtacggcctgaccggtaaaaactgcgtctttgctcactgcgtccatctcgaagaaaaagagtgggatcgtctcagcgaaaccaaatccagcattgctttctgtccgacctccaacctttacctcggcagcggcttattcaacttgaaaaaagcatggcagaagaaagtcaaagtgggcatgggaacggatatcggtgccggaacaacttttaacatgctgcaaacgctgaacgaagcctacaaggtattgcaattacaaggctatcgcctctcggcatatgaagcgttttacctggccacgctcggcggagcgaaatctctgggccttgacgatttgattggcaactttttacctggcaaagaggctgatttcgtggtgatggaacccactgccactccgctacagcagctgcgctatgacaactctgtttctttagtcgacaaattgttcgtgatgatgacgttgggcgatgaccgttcgatctaccgcacctacgttgatggtcgtctggtgtacgaacgcaactaataataaaactttaacatcctcgtgaggacatcattatgtctggagacatcctacaaacaccggacgcaccaaagccacagggcgcgctggataattattttaaaattaccgctcgtggcagtaccgttcgtcaggaagtactggctggcttaacgacctttctggccatggtttattccgttatcgtcgttccgggaatgctgggcaaagcaggttttcctcccgcagctgtgtttgttgccacctgtctggtcgcgggcttcggctcgttgctgatggggttatgggccaatttgccaatggcgattggttgcgctatttccttgacggcgtttaccgcattcagtctggtactcgggcaacaaattagcgttcctgtcgcactgggcgcagtctttctgatgggcgtcatcttcaccgctatttccgtaaccggtgtgcgtacctggatcttacgtaatttgccgatggggatcgctcacggtacaggtatcggtatcggcctgtttctgctgctgattgctgctaacggtgtgggaatggttataaaaaacccgattgaaggcttgccagtggcgctcggtgcctttacctccttcccggtgatgatgagcttactggggctggcggtcatcttcggtctggaaaagtgccgcgtacccggcgggatcttgttggtgattattgcaatttcgatcatcggcttaatctttgacccagcggtgaagtaccacggtctggtggcgatgccaagcctgactggcgaagatggtaagtctctgattttcagcctcgatattatgggcgcactccagccaactgtacttccgagtgtactggcattggtgatgaccgcagtgttcgacgccactggcaccatccgtgccgtcgccggtcaggcgaatttgttggataaagacaaccagatcatcaacggcggcaaagccctgaccagtgactcagtaagttcaatattctccggcctggtgggcgcagcgcccgcggcggtttatatcgaatcagcggcaggaaccgccgccggggggaaaaccggtttaaccgcaaccgtggttggtgtgttgttcctgatgattctgtttttatcaccgttatcgtttctgatccccggttatgccacagctcccgcactgatgtacgtgggtttgctgatgttaagcaacgtctcgaagctggatttcaacgattttattgacgcaatggctggcctggtgtgtgccgtgttcatcgttctgacttgtaatatcgttaccggtattatgctgggctttgtaacactggtggtgggtcgcgtctttgcgcgcgaatggcaaaagctgaatattggtacggtgatcattactgccgcactggtcgcgttttacgcgggtggttgggcaatctaatagattctccgcgcctttcagcgcggagatttctttcacagaggattctcactgctggcaacaatacgctgctggcggactcgcctgagttctctttcagtcagcaactgcagcgcctgtgtcgggcaagattcaacgcaggctggcccctcttcccgctgttcacagagatcgcatttcacgatttgttgccgggtatcccccggcaatgactgaatggtgatcattccaaacgggcacgcactgacgcaactctgacagccaatacaacgggcagaatttgcctgcaccacctgctcgcccatcgtcagcgcccccacgggacaagcgccaacacaaggggcgttttcacactgatggcacatcaccggcgcactgatgctatccagccgttgtaccttcagccggggtaaaaagatatcggcattcaactcctgttctgaagggtgagcgaccacacaggccacttcacaagtacggcagccaatacagtcagccggattaacgataattaacgatttcatcacgatgccttcgtatcaaacagagttaacatatcgcgcgccgcctgccttcctgcggccattgcagtgacaaccagatctgcgccatgaactgcatcaccaccagcaaagacttttttcagatgcgtctgggtgggtaaatacccgacgtcgccggtttgaatcaggccccatttatcgagtttaattccgctgccctgcaaccacggcatggtatgtgcctggaaaccaaaggccataatgagaacatcggcgggcaattcaaactctgaacccgcaaccggacgaggacgacggcggccatccggccccggctcacccatagcggtacgaatcaggcccaccgccgttaagcgtccatcttcatcacaagcgatatattgcggctgaacattgaactgaaactcaacaccttcctcgcgggcattgaccacctctttgcgcgaacccggcatactgacttcatcacgacgatacgcacaggtcacgctggcagcattaaggcggatggaagtccgcaaacaatccattgtcgtatcgccaccgcccaataccacaactcgcttaccttccacatccgtcagcggatactctgcagactccggcaatcccatgagctggcgggtatgggcggtcaggaacggtaacgcctgaatgacaccaggcgcatcttcatgcggcagatctgctcgcatcatcccgtaagtccccacgccgaggaaaacagcatcatattccgccgttaattcgttgaaagagatatcgcggccaatttcacagttgagatggaaatcgattcccattgcggtgaatatctctcgccgctggcttaataccgttttatcgagtttgaaaggaggaatgccaaaagtcagcataccgccaatttctggatggcgatcaaagacatcaacctgaactcccgcgcgcgccagaatatcagcacaccctaatcctgcaggtccagcgccaatcaccgccactttttcgctacggggaacaactttgctgacatcgggacgccagcccatcgccagcgcagtatcggtgatgtagcgttccagattaccgatagagactgcgccagagtgatctttcaaagtacatgcaccttcacaaagacggtcctgtggacataccctgccgcagatttcgggtaaggaactggtctggtggcaaagttctgccgcttcaataatctttccttcctgtaccagacggatgtaatccggaatagcgttatgcagcggacaatgccagttgcagttagctttttcggcacaataaacacagcggtcactctcataagtcgcttgttgtggatccagcccgcaatagatttcgccaaagtgggttttccgttcactcgctgaaattttatctgcgcctttacgcgagttaacggggagcaacgctgcactgcgagatggctgagcgtctgatgacgcttttcctgctgccgttttgcgctggcgggccacctttatctgctgcaaccctttatcgtccatcagccgtaacgcctgtgttgggcagacgtcaatacaggcttgcgtgccggaactgcgctggttacaaaggtcgcatttctgtgcaatcgtatcgaccatctcaacgacgccaaaggggcaagcgattgcgcatcttttacaaccaatacatttttgctcgtccagttgtacgctatcggactggaaagtcagagcattaaccggacaagccgtaacgcaaggggcattgttgcagtgatggcaggccaccggattcgcagcctggcctttccctacaacgtggatacgcggtcgaaagtcactgtgactcagcggccagttttcttgattatgtgccaccgcacaggcaatttcacaagcatggcagcctatacattccgcagcttcagcagcgataaacttattcatttgcatccctttcatttaatgagttatgtcttctcaaatttcgcgatgcaataaacgggcatatattaggtagcatgaccgttttaattataattttgcaactgagttcaaattattgcccctcaatctatgccgctttcattatttcaacattgccgatcaaaagaatgctatccagataaaaacgattaaatgcgagagtgcgacatgccagaatgattaatgaaatatcaatatgagaaaattacagataattccattgtcaggttctcttctcattttcgtggtttaaccacgattatgtgattgcctccgcaattcctgtctctaactccccttcctcgcaaaaactggcactccacgagcatgtgtttagacagtttcatgaacataaacggttgctttttactctggcgggcgaaaggagaaacactgatgagcgccatagattaccaacttccctcatcttctgggcaagaccgcccaactgatgaggttgaccgcatattatcaccaggaaagctgatcatactcggtctgcaacacgtccttgtcatgtacgcaggtgcagtcgctgttcctcttatgattggtgaccgactcggcctatcaaaagaagctattgcgatgctcatcagctcggatctcttttgctgcgggatcgtcacattattgcaatgtatcggtatcggccgctttatggggatccgcctgccggtgattatgtcggtgaccttcgccgctgtaacaccaatgatagctattggtatgaacccggatatcggcctgctggggatattcggtgccactatcgccgcgggttttatcaccacattattagcgccacttatcggtcgcttgatgcctttattcccgccactggttaccggtgtggttattacttctatcgggcttagcatcattcaggtgggtattgactgggccgccggaggtaaagggaatccgcaatatggtaatcccgtttatttaggtatctcctttgccgtcttaatttttatcttgctcattactcgctatgcgaaaggatttatgtccaacgtcgccgtattactggggattgtatttggttttttactttcgtggatgatgaatgaagtcaatttatccgggctacatgatgcttcatggtttgcgattgtcacgccgatgtcatttggtatgccgattttcgatcccgtttccattctgaccatgactgccgtgttaatcatcgtgtttatcgagtcgatggggatgttcctggcactgggtgaaatagtcggtcgtaaactctcttcacacgatattattcgcgggctgcgtgtcgatggtgtagggacaatgataggcggaacgtttaacagcttcccccacacgtcattttctcaaaacgttggcctggttagcgtgacgcgcgttcatagccgctgggtgtgcattgcttccggtatcattttgatcctgttcggcatggtgcccaaaatggcggtgctggtggcctcgattccgcaatttgtgctgggcggcgcggggctggtgatgttcggcatggtactggcgacagggattcgaattctgtcgcgctgtaactacaccactaaccgttacaacctctatattgtggcgatcagtctcggtgttggcatgacgccaacgctctctcacgatttcttttctaagttaccggccgtactgcaaccgttgctgcatagcggcattatgctcgcaacccttagcgccgttgtgctgaacgtcttctttaatggctaccagcatcatgctgacctggtgaaggaatccgtctctgataaagatttaaaagtcaggacagtacgtatgtggcttctgatgcgcaagctgaagaaaaatgagcatggagaataatatgaatcttttaatgcgcgctatattcagtctgctgttgctttttactctctctattcctgtcatttctgattgtgttgcaatggccattgaaagtcgcttcaaatatatgatgctgcttttttaaatggtttttacctgtcgacatccgctcaaaacgggcggttgtcgataaacgctcacttggttaatcatttcactcttctattatctataatgatgagtgatcagaattacatgtgagaaattatgcaaacggaacacgtcattttattgaatgcacagggagttcccacgggtacgctggaaaagtatgccgcacacacggcagacaccctcttacatctcgcgttttccagttggctgtttaatgccaaagggcaattattagttacccgccgcgcccttagcaaaaaagcgtggcctggcgtgtggactaactcggtttgtgggcacccacaactgggagaaagcaacgaagaggcggtgatccgccgttgccgttatgagcttggcgtagaaattacgcctcctgaatctatctatcctgactttcgctaccgcgccaccgatccgaatggcattgtggaaaatgaagtgtgtccggtatttgccgcacgcacgaccagtgcgttacagatcaacgatgatgaagtgatggattatcaatggtgtgatttagcagcggttttacgcggtattgatgctacgccgtgggcgttcagtccgtggatggtgatgcaggcgacaaatcgcgaagccagaaaacgattatctgcatttacccagcttaaataaaaaaccccgacggttgccggggttgtgagcataacgtaatgcttattttaccggacgcatcgccgggaacagaataacgtcgcggatggtatggctgttggtgaacagcattaccatacggtcgataccaattcccagaccggctgtcggtggtaagccatgttccagtgcggtgacataatcttcgtcgtagaacatcgcttcgtcgtcacctgcatctttcgcggcaacctgatccaggaagcgctgcgcctgatcttccgcgtcattcagctcgctaaagccgttaccgatttcacgcccaccaatgaagaactcaaagcggtctgtgatttccgggttaacgtcgttacgacgcgccagaggagaaacttctgccggatattcagtaatgaaggtcggctggatcagatgtgcttctgccacttcttcgaagatctcggtaacgatacggcccagaccccagcttttctcaacgtggatgccgatagattcagcaatcgctttcgcagagtcgaagttgtccagatccgccatgtcagtttccgggcgatatttcttgatcgcttcacgcatggtcagtttttcgaacggtttaccgaagtccagcgttacgtcgccgtaggtcacttccgtcttaccgagaatatcctgtgccagagtacggaacagcgattcggtcagctcgataagatctttgtaatctgcgtaagccatatagagttccatcatggtgaactctgggttatgacgtacggaaataccttcgttacggaagttacggttgatttcgaatacacgctcgaagccaccgaccaccagacgcttgaggtacagttccggcgcgatacgcaggtacatgtcgagatccagcgcgttatggtgagtgataaacggacgcgcagcggcaccgccagggatcacctgcatcatcggcgtttcaacttccataaagccgcggttcaccatgaactggcgaataccagagaggatctgcgagcgcactttaaaggtgttgcgggattcatcgttagagatgagatccagataacgctgacgatagcgcgcttcctgatcctgcaagccgtggaatttatccggcagcggacgcagtgctttggtcagcagacgcagctcggtacagtggatagacagttcgccggttttggttttgaacagtttacctttcgcgccgaggatatcgccgaggtcccattttttgaactgctcgttgtaaacgccttccggcagatcgtcacgggcaacgtacaactgaatgcgaccgccaacgtcctgcagggtaacgaaagacgctttacccataatacgacgggtcatcatgcggccagcaacggcgacttcgatgttcagcgcttccagttcttcgttctctttaccgtcgaattctgcgtgcaattggtcagaggtatgatcgcgacggaaatcgttcgggaaggcaatcccctgctcacgcaggttcgccagcttctcacgacgcgttttcagttcattgttaagatcgactaccgcgtcagcgccctgtgcgtgttgttcagacatgttggttcctcataaccctgctttcaaacttgcttcgataaattgatccaggctgccgtccagcacggcctgcgtgttgcgggtttctaccccggtacgcagatctttaatgcgggagtcatcaaggacataagaacgaatctggctgccccagccgatgtcggatttattgtcttccatcgcctgtttctcggcatttttcttctgcatctccagttcataaagcttcgctttcatctgcttcatggcttggtctttgttcttgtgctgggaacggtcgttctggcactgagtcacgatcccggtcgggatgtgagtaatacgcaccgcagattcggtacggttaacgtgctgaccgcccgcgccggacgcgcgataaacgtcaatgcgcagatccgccggattgatttcgatatcgatatcgtcatcaacttccgggtaaacaaacgcggagctgaacgacgtgtggcgacgaccgccggagtcaaacgggctcttacgcaccaggcggtgaacgccagtttctgtacgcagccagccgtaagcgtaatcgccggagattttgatcgttacggatttaatacccgccacttcaccttccgactcttcgataatttcagttttgaaaccacgcgattctgcccagcgcagatacatacgctcaagcatgctcgcccagtcctgtgcttccgtgccgccagaccccgcctgaatatcgaggtagcagtcggcgctgtcatattcgccagagaacatacggcggaactcaagctgcgccagtttttcttccagggcgtcgagttcagcaacggcttcgttaaaggtttcttcgtcgtcagcttctacagccagttccagcagaccagaaacatcttccagcccctgtttcatttggtcgagggtgtcgacaacggcttcgagggaggaacgctctttacccagcgcctgtgcgcgttcgggttcgttccagacatccggctgttccagctcggcgtttacttcttccagacgctctttcttggcgtcatagtcaaagataccccctaagaacgtcggagcgttccgtgaggtcctgaatgcgattatttaccggattaatttcaaacatggtctgatttcttttattgagctagtcaaaatgcggtgataagagcgggattgtacccaatccacgctcttttttatagagaagatgacgctaaattggccagatattgtcgatgataatttgcaggctgcggttgccgcgaaactcgttgatatcgagcttgtaagccagttgcacttcgcgcacaccgttatccggccagagggcggtatcgacattaaaagcaatcccgtccagcagtggaccgccgccgaccggttcgaccatgactttcaaatgacgttcgcccaccagccgctgttgcagcagacgaaaatgaccgtcaaacagcggctccgggaacatctgcccccacgggccagcatcgcgcaacagctgcgccacttccatggtcatttcggccggacttaacggaccgtccgacaccacttcgccttgcaatagcgaagggtccaaccactccgtaaccagttcgccaaaccgttgttgaaagagttcgaatttatcctcttccagcgacaaacccgccgccatcgcatgaccgccaaacttgagcatcatgccggggtagagtgtgtctaatcgctccagcgcatcacgcatatgcagcccctgaatggagcgaccggaacctttcagcgtaccatcaccagctggcgcaaaggcgataaccggacggtgaaaacgctctttgatacgcgatgccagaatgccaacaacgccctgatgccattcggggtgatacattgccagcccgccgggtagcgtgtcgcggctgcgctccagtttctcgcacaaggtcagggcttcaacttgcattccctgttcgatctcttttcgcgtctggtttagcgcatcgagttcatttgccagcacgcgcgcttcgccgatgttgtcgcacagcaacagcgccacgccaacggacatatcgtccagtcgcccggcagcattgagacgtggccccagcgcaaaacctaaatcgctggcggcgagtttttgtggatcgcgattggccacttccagcagcgctttaatccccggacggcactttccggcacggatgcgactcatcccctgccaggtcagaatgcgattattagcgtccagcggcacgacgtccgccactgtccccaacgctaccagatccagcagttctgccagattaggaattgcgatgccgcgctcatcaaaccagccctgatcgcgcaaaaaggtgcgcagcgccagcatcagataaaacgccacacccacgcctgccagtgatttcgacgggaaattacagtcgcgcaagttagggttaatgatcgcttccgctgcgggtaatgtgtcgcctggcaaatggtgatcggtaacaataaccggaatgcccaacgaacgagcgtgttcaacccccgcatgggaggaaataccgttatccaccgtgacaattaactgcgcgccacgggcatgagcctgatcgactacttccgggcttaagccgtaaccgtcttcgaaacggtttggaaccaggtagtcgatattgctgcaaccaagcgagcgcatcgccagcacgcttagagccgtgctggtggcaccgtcggcgtcgaaatcaccgaccacaataatccgcgtgccttcgcgaaaagcgttgtaaaggatctcaacggccttttcgacgccgctcagttgctgccagggcagcatgcctttaacactgcgttccagttcctgcgcgctacgcacaccccggctggcatataaacggcgcagcaagggaggcaattcagcgggcaagtcggccgtttcatcgacttcacggcgacgaagttgtatctgttgtttcacgcgaattatttaccgctggtcattttttggtgttcgtcgaggaattctttcatgtctttcggcggctggtaacctggaacaagtgtgccattgctcagcacaactgccggagtaccgctaacgccaagctggacgccaagtgcgtaatggtcggcaatatccacgtcgcagctggctggtgcgacgcttttacctgccatcacatcatcaaacgctttgtttttatctttcgcacaccagatagctttcatttctttctctgcatcgctgtccagcccctggcgcgggaaagcaagataacgcacggtgatccccagcgcgttatagtctgccatttgctcatgcagtttgtggcagtaaccacaggtaatatcagtaaacacggtgatgacgtgtttttcctgcggcgctttataaacgatcatctctttttcaagcgcattcaactgctttaacagcatcttattggtgacattgaccggagccgtgccactaacgtcatacattggcccctgaatgatatgtttaccatcatcggtgatgtacaacacaccgctgttagtcagaactgtcttcatgccagcaacgggcgcgggctgaatatcgctgcttttgatgcccattttggctaacgtttgttgaattgccgcgtcatcagcctgaacaaagcctgaaaacgctgccaacaaggtaaataacataaaacctttcttcataaattttcctgttcttttcagacatcacgcccgcgggtgatgctgttgatgaagttgccgcagacgctcggtagcgacatgcgtataaatttgcgtggtggagagatcgctgtggcccagtagcatctgcaccacgcgcaaatccgcaccatgatttaataagtgagtggcaaaagcgtgacgcaacacatgcggtgacagcttttcgctgtcgatacccgccagcacggcataatgtttaatgcggtgccagaaggtctgtcgcgtcatctgctgcgcacgctggctgggaaacaacacgtcaattgacacaccattcaacagccacggacgcccatgttccagataggtttccagccagtaaaccgcctcttcacctaacggcaccaggcgctctttgttgcctttaccaatgacccgcactacgccctgacgcaggctgatatcactcattgtcaacccgaccagttcagagacacgcagtccggtagcatacaacacttcaagcatggctttatcgcgtagctccagtggctgatcaattaatggtgcctgtaataaacgttcgacctgcgcttcgcttaaatcttttggcaaacgctggggcaatttcggtgaagcgagatgcgcactgggatcatcttcacgaaacttttcgcgataaagatactggaacaatcggcgcactgcactcagcaaacgcgctgagctggtggctttatacccgccctccagccgttctgccagtaatgcctgcaaatcgtcactttgcgccgtcgccagcgtcaacccgcggtgatgcaaccactccaccatcattgacagatcgcgacggtaagcgttcaacgtattttcagccagatttttttccagccacagagcatcaagaaactgctcgatgcgtgccagctcctgtttcacttgcgccccttatggtcactcatttgatccattatgccttattgtgccgtgactaaagcgattctgatacactagccgcaaaagccacagcagaatcgagaagcttacgttatgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcatcctgggtatcccgacctgggattttggcgaaatccaggaagactgggaagccgtctgggatcagctcgacgacctgaacctcgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcaaagctggtgcgagcaaatcctcaacgaaatggcagagcattacgcctgatgtcactgacggcttagcgcatatgctttgccgtcatttttatctttgcgtctcttgttgcaacaaaatccgccgtaaatcccgccattcggcttcgtccatgctgtcggctgccagccataaatgttgccgtttaccgctatcagaacgtaaacgcagcatcatgccgctcttaatcatccacggcgctttgacgatgctccactcctgcccttgccagcgcaaacgcccgtccatcaacaggcgaatttccccctggcgagcattaatgcgccgctggctgcgaacgcaatcaaacaccaccagcgaaagtaacaccatccataacggggtgtaactgagcggccagggcatgagtaaaataacagcggcaaccagcccatgaatcagcaaggaaagccactgtgcgcgccaggagacgcgcaaatcagattgccacaggaccacgttcccggttccgtgtctggatgagtcggaccatcatttccagttctgcatcggctggtttaccgtgattcatcagccagttaaacaggtccggatcgtcacattccagcagacgaataaagatgcgtttttcgtcatcgcttaagctgtcgtactcatgttcgaaaaacggcatgattgaaatatcgagttcgcgcataccacggcggcatgcccaatgaatgcgggctttgttgttaatgtccatcttcttcctgtctcacgaaaatccagtacccggctattgtaacgtgtttttcgacttcttttacgggaatatcagtaaacacaatcgcgatcgcgaaattaattcacaacaattcaagggcttcatttttttggaagtcgcctcgcagaaggcacagatcgcgtagtgaaagcacttgcattgcctcatagctcttttaccattagttattaatacgccgttaagcaactcaggactctattatggcttttacaccttttcctccccgtcagcctacggcttctgcccgtttgccactgacgctgatgacgcttgatgactgggcgcttgccactattactggcgcggacagcgaaaaatatatgcaaggccaggtgacagcagatgtcagccagatgactgaagatcagcacctgctcgccgcccattgcgacgccaaaggtaaaatgtggagcaatttacgtctgttccgcgacggcgatggctttgcatggattgaacggcgcagcgtgcgtgaaccgcagctgactgaactgaaaaaatatgcggtgttctctaaagtgaccatcgcgccagacgacgagcgtgtgctgcttggtgttgccggttttcaggcgcgcgccgcgttggcaaatctctttagtgaactaccttcgagagaaaaacaggtagtcaaagaaggcgcgaccacgttgctatggtttgaacacccggcagaacgtttcctgatcgtaaccgatgaagctactgccaatatgctgaccgataaactgcgcggtgaagcggaactgaacaatagccaacagtggctggcattaaacattgaagcgggttttccggtgattgatgccgccaacagcgggcagtttatcccccaggcgaccaacctccaggcgctgggcggtatcagctttaagaaaggctgctataccggacaagagatggtggcgcgagcaaaattccgtggtgccaacaaacgcgcgctctggttgctgaagggtagcgccagccgactgccggaagctggtgaagacttagagctgaaaatgggcgagaactggcgtcgtaccggtacggtgctggctgcggtcaaactggaagatggtcaggttgtggtgcaggttgtcatgaataacgatatggaaccggacagcatcttccgcgtgcgtgacgatgcgaatacattgcgtatcgagccactgccatattcgctggaagagtaaatctctgtatcgcatcaggcatttatcgcctgatgcgacactggtgtgtcttttcaggcctacaaaggcacgccaattacgcctgcccaatatacaaatagatcgccagaaagtggcacacactaccgccgagcacaaagccgtgccagatggcatgattgtatggaatgcgcttgcagacgtagaaaatcaccccgagcgaataaaccacaccgcctaccgccagtaaggtaacgctgcccgccgcgagcttaactgccatttcataaattaccaccagcgacagccagcccatcgccagataggtcaccagagataaaattttgaatcggtgcgcgatggtcagtttaaacagaatacccagcaatgccaggctccagataacaatcatcaacccgcgcgctaacggagaatccagccccaccagcaaaaacggcgtataggttccggcaatcaacagataaatggcacagtggtcaaatttcttcagccacatttttgcccgttgatggggaatggcgtgatagagcgtcgaagcgaggaacagcaggatcatactgccgccatagaggctgtaactggttatcgccgtggcgctggcattgagatccaccgcctgaaccagtagcaacaccagcccaacgataccaaacaccagcccaatgccgtgactgacgctgttggcaatttcctctgccagcgaatatccctgcttaatgaggggcttctgaaccataacttactccggaaaaacgtacacgcacatgtatacctctccagcgtaactgagaatagttccagtgaacacctgttagctaaaataaattctgatttgagattaatctccgaaaaatcataaaattaaatgcgaaatttcaactaacaggcgtgagttcaatttaaagacatttaaattcaatcacataaaactgtgtctggtcgggatagatgtcggcaatgacctttttcagttcagtcagggtcatattttcctgctctgcatgtttttccgtcagcgtatccagcgttacggttgaggttgcggtgacttcaatcgtgcaaaaataaccgtcatcttcaaaacgtccgacacgaagcacatcacccgttttgaagtgcgattcagactcgtcgcggatggtgatggttttacgcccagccagaatgtcatcctggaaacgttgaaaaaaagtgatgtcgtttggctgcatggtactatttcctgtaagaattgactcatctggagcctatgatagtgaaaaaactcaccttaccgaaagatttcttatggggcggcgcagttgccgctcatcaggtcgaaggcggctggaacaaaggcggcaaagggccgagcatttgtgacgttctgaccggtggcgcacacggcgtgccgcgcgaaatcaccaaagaagttgtgcctggcaaatactatccaaaccatgaagccgttgatttttatggtcactacaaggaggacatcaagctatttgccgaaatgggcttcaaatgttttcgtacttccatcgcctggacgcgcatttttccaaaaggcgatgaagctcagccaaacgaagaagggctgaagttctacgatgatatgatcgatgaactgctgaaatacaacatcgaaccggtgatcaccctctcccactttgaaatgccgctgcatctggtgcagcaatatggtagctggaccaaccgtaaagtggttgatttctttgtccgtttcgcggaagtggtatttgaacgctataagcataaagtcaaatactggatgaccttcaacgaaattaacaaccagcgtaactggcgtgcaccgctgttcggttactgctgctccggcgtggtgtataccgagcatgaaaacccggaagagacgatgtatcaggtgctgcatcaccagtttgtcgccagcgccctggcggtgaaagccgcgcatcgcatcaacccggagatgaaagtcggttgtatgctggcgatggtgccgctctatccttactcctgtaacccggacgatgtgatgtttgcccaggagtcgatgcgcgaacgttacgtctttaccgatgtgcagttgcgtggctattacccgtcctatgtgttgaacgagtgggaacgccgcggatttaacatcaaaatggaagacggcgatctggatgtactgcgcgaaggcacctgcgattatctcggcttcagctattacatgaccaacgcggtgaaggccgaaggcggcaccggcgatgcgatctctggttttgaaggcagcgtaccgaacccgtatgttaaagcgtctgactggggctggcagattgatccggttggtctgcgttacgcgctttgcgagctgtatgagcgttaccagaagccgctgtttattgtcgaaaacggttttggcgcttacgacaaagtggaagatgatggcagcatcaatgacgattaccgcattgactacctgcgcgcccatattgaagagatgaaaaaagcggtgacttacgatggcgtggacctgatgggctacacgccgtggggctgcatcgactgtgtgtcgttcaccaccgggcagtacagcaaacgctacggctttatctatgtgaataaacatgacgacggtactggcgatatgtcgcgttcacgtaagaagagctttaactggtacaaagaggtgattgccagcaacggcgagaatctgtaattagccgatgtgcctgatgtgctccgctcatcaggcctggcactcttttaatatattgagctcgcaatattttatattacgcctcagccgaaacacacaaagcgcactttattaacaagcgaaaaaggcgccgaagcgcctttataagatagtcgaatcagtaaattactggtattcgctaatcggtacgcaggagcagaacaggttacggtcgccgtaaacatcatccagacgtttcacggtcggccagtatttgtctgccacacctgccgggaatactgcaacttcacgactgtacggatgcgcccactcggcgaccagttcgctctgaatgtgcggcgcgttcaccagcgggttatcttccagcggccagacaccggctttcacctggtcaatttctgcgcggatagccagcatcgcatcgataaagcgatccaattccactttgctttcagattcagtcggttcaaccatcagcgtacccgccaccgggaacgacatggtcggcgcgtggaaaccgtagtcgatcaggcgcttggcaatatccagctcgctgatgccggtttcttctttcagcgggcgaatatcgagaatacattcgtgcgccacgcgaccgtcgcgaccggtatacagcaccgggaaggcatcctgcagacggctggcaatatagttggcgttaagaattgccacctggcttgcttttttcagcccttctgcgcccatcatgcggatgtacatccagctgattggcaggatagaggcactaccgaacggtgccgcagaaaccgcgccctgacgggttaacatgccttcgatttgcaccacgctatgacccggtacaaacggagccagatgcgctttcacaccgatcggtcccatacccggaccaccaccgccatgcggaatgcagaaagttttatgcaggttaaggtgggaaacgtccgcaccaataaagcccggcgaggtgatgccaacctgagcgttcatgttcgcgccatcaaggtaaacctgaccgccgaactgatgcacgacttcacacacttcacggatcgtttcttcatacacgccgtgggtagaaggataggtcaccatgatacaggagaggttatcgcccgcctgttccgctttcgcgcgcagatcagtcagatcgatgttgccgtttttatcacacgccacaaccaccacctgcattcctgccatatgcgcggaagccgggttagtgccgtgcgcagaagccgggatcaggcagatatcgcgatgcccttcgttgcggctttcatgataatgacgaatcgccagcaggcccgcgtattcgccctgtgcgccagagttcggctgcatacaaacggcgtcgtaaccggtcagtttcaccagccagtcagccagctgcgcgatcatctgctgataaccttcagcctgttctggcgggcagaacgggtgcagttcggcaaattccggccaggtgatcgggatcatctcggcggcggcgttcagtttcatggtgcaggaacccagcgggatcatcgcctgattcagcgccagatctttacgctccagcgagtgcatatagcgcatcatttcggtttcgctgtggtagcgattaaacaccggatgggtgaggatttcgtcgtcgcgcagcatcgcagcctgaatagagcgactgtcgtgagccacgtctttgtccagtgtgtcgatgtccagcccgtggttatcgcccaacagcacgctgaaaagctgcatcacgttttcgcgcgtggttgtttcatcaagggtgatcccaaccgcgttcagaatatcgctacgcaggttgatttcagctgcttcggcacgcgccagcacgcccgctttgtcgaccacttccacacacaaagtatcgaaatagtgcgcatggcgcagcttcagacctttttgttgcaggcccgccgccaggatatcggtcagacggtggatgcggttagcgatacgtttcaggccaaccgggccgtgataaacggcatacaggctggcgatgtttgccagcagtacctgggaagtacaaatgttggagttcgctttctcacgacgaatatgttgctcgcgagtctgcatcgccatgcgcagagcggtgttgccagctgcatctttcgatacaccgataatacggcccggcattgagcgtttgtattcgtctttcgccgcaaagaatgccgcgtgtgggccaccgtagcccatcggtacgccaaagcgttgcgccgaaccaaaaacaatatccgcgccctgtttacctggcgcagttaacagcaccagcgccataatatcggcggcaacgctgaccacaattttgcgtgatttcagttcgctaataagcgcggtgtagtcgtgaatttcaccagtagtgccgacctgctgtaacagcacgccgaaaacgtcctgatggtcgagcactttttgcgcgtcatcgacaatcacttcaaaaccaaaggtttcggcacgagtacggaccacatccagcgtttgcggatgaacgtcagaagcaacaaagaagcggttggcatttttcagtttgctgacgcgtttcgccatcgccattgcttctgcggcagcggtggcttcgtcaagaagagaagcagaggccatatccagcccggttaaatccagcgttacctgctggaagttgagcagtgcttcaaggcggccctgggagacttcaggttgatacggagtatacgcggtataccagcccggattttccagcatgttacgcaggataaccggcggtagctgcacggcggtgtaacccatgccgatgtaagacgtgaagcgtttattgcgactggcaatagccttgagttctgccagtgcggcgtattcggtcgccggtgcgccaacctgcggcggagtcgcaagctgaatatctttcggcacaatctggccggtcagcgcgtttaacgattgtgcgccaacggcattcagcatttcttgctgttgcgcggcgtccggtccgatatggcgttcaataaaagcgccgctgttttcaagctggcttaacgtctgtgtcatgagcgatggttcctgaaacgtgcagtgaattgtgaacctctctccttgcgaagagagtgagggtgaggcgtaaatttcctcaccctgatcctctcccgcagaagaggaataaagccgttactcgtcttctaacaatgcttcgtatgcggttgcatccagcagtgattccagttcgctttcatcgctggctttgattttgaaaatccagccgcctgcatacggttcgctgttcaccagttccggggaatcgctcagtgcatcgtttaccgccacgatttcaccgcttactggcgcataaatgtctgacgccgcttttaccgattcggcaaccgcgcagtcatcgcccgcgctaaccgttgcgcccacttccggtaggtcaacaaacaccatatcgcctaacagctcctgagcgtgttcggtgatgccaacggtgtaagtgccgtcggcttctttacgcaaccattcgtgttctttgctgtatttcagttctgctggtatgttgctcatcaatcaatctccaaaaaagtaaatcacgcgacggctttgccgttacgcacaaaaacaggtttcgtcactttaaccggcatttcacggttgcgaatttgcacaatcgccgtttcaccaataccttccggcacgcgcgccagcgcaatgctataacccagcgttggggagaaagtaccgctggtgataatgccttcatgctggttgccctgcgcatcagtaaaacgtaccggcagttcattacgcagcacgcctttttcggtcatcaccagaccaaccagtttttctgtgccatgttcacgctgcgcttccagagcttcacgaccgataaagtcacgatctgccggttcccaggcgatagtccagcccatattggcggctaaaggagaaatagtttcgtccatctcctggctatacaaattcatgcccgcttccagacgcagcgtgtcacgcgcgcccaggccacatggcttaacgccagcttccaccagcgcgcgccagaaatcggccgctttttcattgggcagcgcaatttcgtagcccgcttcaccggtgtaaccggtggtggcaataaacagatcgcccgcctgcacgccaaagaacggtttcatcccttccaccgcctgacgctgggcgtcattaaacagtgtggcagcttttgcctgcgcattcggcccttgtacggcgatcatggaaaggtcatcacgaacagtaatttcgatgccgaaaggttcagcgtgttgggtaatccaggagaggtctttttcgcgggtagcggagttaacaacgaggcggaagaaatcttcagtaaagtagtagacgatgagatcatctatcacaccgccagaggcattcaacatccccgagtaaagggctttgccgcttttggtgagcttcgccacatcgttcgccagcagataacgtagaaactcccgggtgcggctgccgcgaagatcgacgatggtcatatgtgacacatcaaacattccggcatcggtacgtaccgcatgatgttcgtcgatttgcgaaccgtaatgcagcggcatcatccagccgtggaaatccaccatgcgagcgccgcaaagcgtgtgttgttcgtacaaaggagtctgttgtgccatcttgtcctcattgaataagcggggctgacaacttttccatggcgaaattatcaccacgaaacccagcatcggagccactcccggtccccaacgcaatcgttctcttttgcctgaacttaccaccgaaacagactgttaaccataaggtaaaattgatcatcacattagcttatggttaaaaaacgccaaaatcgcaacagaataaaaaaccaaaaaatgaacaaatctctatataaagataaatagatgagaaagttaatttgaataagacaacattaagaactaaaaaaatgtcaaaaaacactaaatcaaaaattcgtggcattagaaaatataatgcgaaatcgcaggtgaaattagtttatttcaaatgaggaaaatctcccggcgaaaaaaccgggagatgaaagtgtgatgggtatcaaataaacagcagaagagaaatatttaacgcagccattcaggcaaatcgtttaatcccattgcctgacgaataagttgtggcttaacgccaggaagcgtatcagccagtttcagaccaatatcacgcagcaattttttcgccggattagccccggaaaacagatcgcggaatccctgcataccagccagcatcagcgccgcgctgtgcttgcggctacgctcatagcgacgcaggtaaatgtactgcccgatgtctttaccctgacgatgcaaccgtttcagttcagcaatcagctctgcagcatccataaagccgagatttaccccctgccccgccaacgggtgaatggtatgcgcggcgtcgcccaccagcgccagacggtgcgcggcaaactggcgcgcataacgccccgttagcgggaacaccaggcgctcactttcaaccttgcataagcccaggcgattatcaaaagcgatatttaacgcgcgattaaattcgtcttcactagcctgctgcatccgcagcgcttcctctggcgacagtgaccagacaatcgagcaaagatacggatcgctaagcggtaaaaaggccagaatgccttcgccatggaaaacctgccgcgccaccgcatcatgcggttcttccgtgcgaatggtcgccaccagcgcgtgatgctgataatcccagaaagtcagcggaatatcggctttgttgcgcaaccaagaattagcgccgtctgcgccaatcaccagacgcgccgttaacatgctgccatctttcaacgtcaggaaggtttcattttctccccaggcgacctgctgtaattctgcgggggccaacagagtgatatctgacgactgccgggctttgttccacagcgcgtagtgaatcactgagttttcaacgatatgcccaagatgactatagcccatgctttgatcgtcaaacgaaatgtgaccaaaactgtctttgtcccacacttccataccgtgataacaactggccctacgagagagaatgtcctgccagacgccaagacgggtgagtaatttttcgctggcggcattgatagccgaaacgcgcagttgtggtggtgcatccgccgccagaggttccggtacgcgctgctccagtacggcaacgcgtaagccgctcccctgtaagccgcaggcaaccgccagccccaccatgccgccaccaacaatggctacatcaacactttgcattgtttattccttaaaaccgccttcaacgcgccacccaaccgagggtgcgctgcgccagcacatcgcgtgccggggtaaataattccatcgtcatcagcccgatgttgcgcccgacaaccagcggggtccaacggttggcaaaaagatgtacaaggctgtccgtgacgccgatggttgcttcgcgatcgctctgtcgacgctgctgataacggcacaatacgccgtaatcacccatgtcttctccgcgttcctgcgcctgagtcagggtttccgcaaggctcatgacatcacgcataccgaggttaaatccttgcccggcgatgggatgcagagtttgcgccgcattgcccaccagcacggtacgatgggtaataggtttggcggcgcgggttagcgctagcggataagcactgcgtttaccggcatgagtaattttcccaagtcgccagccaaaggccgactggagttcacggcaaaacttctcgtcgctccacgacagcacctcttcgcgccgttccagtggatgacaccagaccagcgaacagcgtccgtcagacatcggcaacatcgccagcgggccatgttgcgtaaagcgttcaaaagcgcgcccttcatgcgcaacggaagtcgcaacgttggcaatcacagccagttgttcgtaaggctcctgctgccagtcaacgccgcacacggtggctaacgctgaatgggtgccatcagcggctaccagcacgcggcccgtcagcgtctcaccactctccagcgtcacttcaacgtggctctgagtacgggcaacgttagccacgcgatcagggcaatgcagcgttacgccaggtgctttgcgcagcaatgcaaacagccgttgcccgacattgtgcaattcgacaacctgccccagcgccgccagttggtaatcttctgcggcgagggtgacaaatccagcgtgaccacgatcgctgacatgcactgtggtgatggcagttgcgcaatcagccagagattgccagacgccgatgcgcgccagttgctgacaggtacccgccgccagcgcaatagctcgtccatcaaagcccggatgcgcatgtgactctggcgcggtcgcttcaatcaaatgtactggcagcgccccgtgacttaaccgggaaatagccagcgccagcgtcgcgcccgccatgccgccaccgacgatgattactctcattgctttctcgcagctgccatcaacgcttcgatttcttccggctttttcaccacgctggcggtgaggttttcattaccggtttcggtaatcacaatatcgtcttcaatacgaatgccgataccgcgatactgttctggcacttctgcatccggcgcaatatacagccctggttctacggtcagaaccatacccggttccagaatacgcgagcgatcctgaccataaacaccaacgtcatgaacatccagtcctaaccagtggctaaggccatgcataaagaaaggacgatgggcgttctgagcgatcagttcatcaacttcacctttcaggatgccgagttttaccagaccgctaaccatgatgcgcaccacttcaccagtgacttcctgaatggaagttcccggacgatacaggcgcaggctggtttcaagagactccagcacaatgtcatagatttcacgctgagcctgagtgaatttgccgttgaccgggaaggtgcgggtaatgtcgccagcgtaacctttgtattcacaacccgcgtcaatcaacaccaggtcaccgtcacgcagttcacactcgttttcggtgtagtgcaaaatgcagccgttttcaccgctgccaacaatggtgttataggaagggtaacgcgcaccgtggcggttaaattcgtggtgaatttcgccttccagatggtactcgaacatccccggacggcatttttccatcgcccgtgtatgcgccagtgcggtgatttcacccgcgcggcgaagtacggcaatctcttctggtgatttgaacaggcgcatttcatgaacaacaggacgccagtcgatcatcgttgccggtgcggtgagattttgccgcgaacctttacgcagtttctcaagcgcgctgttcacgatttcatcagcatatgcatgttcgccctgggcgtggtaaaccacatccagaccattaagtagttgataaagttgctgattgatttcgctgaatgccagtgcgcggtcaacgcccagtttctctggcgcggcatcctggcctaagcgacgaccaaaccagatctctgccgtcaggtcgcgaacgcggttaaacaaaacgctgtggttatgagtgtcatcgcttttaatcagcaccagcaccgcttccggttcgttaaagccggtgaagtaccagaagtcactgttctgacgataggggtattcgctgtcggcgctacgtgttacttctggtgcagcaaaaatcagcgcggcgctgccgggttgcatttgctctaccagggcctgacggcgacgctgaaattcttgccgggatatatcactcataacactctccttacgttttttgtttttagtgtagagtcggtttttgtacttctggcgcggtcggttgcggatgagtaaaggtgtcgtggcataacagcgcggcaacacggacgtactcgatgatctcttcaagcgacatttcaagctcttcctgatcttcgtcttcgtcgtaacccaactgcgcgatgttacgcagatcgtcgatggcttcaccggtttcgccggtcactttgtccagcttcggttgcgtaacgccaagaccaagcaggaagtgattgacccaaccagccagcgcatcagcccgatcgaaaacgctgacatcatcgccatcaggcagataaagctgaaaaaggaagccgtcatcctgcagggcatcgctggtggcagagtgcattttgcgcagtgcctgtgccagctcatgaccgaaagccatgccttcgttcgtcaggtcgtgaagtagcggcagccatgagctgtcatcgttaccgccacatatcatcccactgattaaaccatgcatctcagcaggggtcagacccgtcccttgttggttcagatactggttcatttcgttgtaaccaggcatttcgttctgtatagacataagcattcgtcgtcaaagggaggaatattcatgatatgctaccactttgggccctggtggaccagaaaagggcttgtctcttctcatcagggtagctatagtgtcgccccttcgcagaccatgggtctaaagacgaaggcagcgcagtcaatcagcaggaaggtggcatgtctgcacaacccgtcgatatccaaatttttggccgttcactgcgtgtgaactgcccgcctgaccaaagggatgcgttgaatcaggcagcggatgatctgaaccaacggttgcaagatctgaaagaacgcactagagtcacaaatactgaacagttggtcttcattgccgcattgaatatcagctatgagttagcgcaagaaaaagcgaagactcgtgactacgcggcaagtatggaacagcgtattcggatgctgcagcagaccatagaacaagcgttacttgaacaaggtcgcatcaccgaaaaaactaaccaaaactttgaatgacacttttcggtttactgtggtagagtaaccgtgaagacaaaatttctctgagatgttcgcaagcgggccagtcccctgagccgatatttcataccacaagaatgtggcgctccgcggttggtgagcatgctcggtccgtccgagaagccttaaaactgcgacgacacattcaccttgaaccaagggttcaagggttacagcctgcggcggcatctcggagattcccttcttacctggcaccagccatgacgcaactaccagaactcccactgacattatcccgacaagaaatccgcaaaatgattcggcaacgtcgtcgtacgttaacgccggaacaacagcaggaaatgggtcaacaagccgctacccggatgatgacgtatcccccagtggtgatggcgcatacggtcgctgtattcctctcttttgatggcgaactcgacacccagccactcatagaacaactctggcgcgccggtaagcgcgtatatcttccagttttgcatccctttagtgccggtaacttgctgttcctgaattaccatccgcaaagcgaactggtgatgaacaggttgaagatccacgagccaaaactggacgtgcgcgatgtgcttcccctttcccggttagatgtattgatcacgccgctggtggcttttgatgaatacggtcaacgcttgggaatgggcggtggtttttatgatcggaccttacaaaactggcagcactataaaatgcaaccggtgggttatgcgcatgattgccagttagtagaaaaactcccagtggagaaatgggatattccactgcctgcggtggttacaccgtcgaaagtctgggaatggtaagggcgatacatcccgcatcgccctgattgacatcgttgattctttgacctaatttagtgagtaagggtaagggaggattgttcctcccctgtgactgactgttaataagccgggaaacttatgagtaacagtacaatcagtatgatgacaagtcgcatcataacccttctccttcaagccctcgcttcggtgagggctttaccgttacagccccatgctgccctgccatcgtaaatccccattaaataaacacaacgcattgatctgactttgatttattttctggagcagactcgcaaagtagaatgcgcaatgcggcaacggtgtggagaagggataaaaaaacgggcaagtcagtgacctgcccgttaattttcagagaaggggaattagtacagcagacgggcgcgaatggtacccggaatagctttcattgcctgcagcgctttttcggcaacgtcttcgtcggcttcaatatcaataactacataacccatctgggcggaagtttgcagatattgcgcggcgatgttgacgccctgctcggcaaaaattttgttgagcgcagtcagcacacccggacggttttcgtggatgtgcatcagacgacgaccaccgtgcagtggcagcgagacttccgggaagttcaccgcagagagcgttgaaccattgtcagaatacttgatcaatttacccgcaacttccagaccgatattctcctgcgcttcctgagtcgaaccaccaatgtgtggcgtcagaaggacattgtcgaattcacacagcggagaggtaaatggatcgctattggtcgccggttccgtcgggaatacgtcgattgccgcccctgccagatgtttgctcgccagcgcgtcacacagcgctggaatatccaccacagtaccgcgcgaagcattaatcagcagcgagccgggtttcattagcgaaatctctttcgcgcccatcatatttttggtggacggattctctggtacatgcagactcaccacatcgctcatattcagcaggtcagaaagatgctgtacctgagtggcgttgcccagcggcagtttgttttcaatatcataaaagtaaacatacattcccagcgattcagccagaatgcccaattgcgtaccaatatgaccgtagccgatgatacccagctttttgccgcgcgcttcaaaagaacccgccgccagtttgttccacacgccacgatgcgctttagcattggcttccggcacgccgcgcaatagcagcagcagttcgccaatcaccagctccgcaacagagcgcgtatttgagaacggtgcgttaaataccgggatcccgcgctttgccgccgcatccagatcaacctggtttgttcctatacagaaacagccaatagcgaccagtttttctgcggcgttgatcacgtcttcagtcagatgggtacgggatcgcaggccgatgaagtgggcatcgcggatggattcttttaattgttcatcatccagcgcgcctttgtgaaattcgatgttggtgtaaccagctgcacgaaggctttccagcgccttttggtgcacgccttctaccagcagaaacttaatcttgtctttctccagcgatacctttgccatttacccaatcctgtcttttgaaatgttgtgtgcggatttgcatccgcctttcaacatatcaaaaaataatattgcggcaatatgaacgtttgcgtcgcgatgttgaggaaatatcacgcaaaagtatttcttggatgaatatgctggtttagaggatttatttagagcaatcgacaattgccaggtaaaaacgtgacacatgtcaccaaatttaatgaatagaatttttttaacgggggaggttcccccgtcagatcatttcacaatagttttgacaccgtcaggtgtgccaatcagcgcaacgtccgcgccacggttagcaaacaaaccaacagtcaccacgccaggaatcgcatttatggcgttttccatcgctatcgggtcaaggatttccatgccgtggacgtcgaggatcacgttgccgttatcggtcactacgccctgacggtattccggacgaccgcccagtttcaccagctggcgcgccactgcactacgtgccatcgggataacttctactggcagcgggaatttgcccagaatatcaacctgcttggaagcgtctgcaatacagataaatttttccgcaaccgaagcaatgattttttcacgggtcagcgccgcgccgccgcctttgatcatttgcatgtggccgttgatttcatctgcgccatcaacgtagatgccaaggctgtcgacttcgttgagatcaaaaacgtgaatgccgaggcttttcagtttttcagtggaagcatctgaactggaaacggccccttcaatctggcctttcattgtaccgagtgcgtcaataaagtgtgcggcggtggaacctgtacctacaccaacaatggtgccgggctgaacatactgaagtgccgcccatcctactgcttttttcaattcatcctgcgtcatgatcgtttcgcctgtggtatgaaatttcacacgcattatatacaaaaaaagcgattcagaccccgttggcaagccgcgtggttaactcatccataaaatatcgcgcaatggcgggcatcccctttcgccccgcaaataaagcatacaacggtctgggtatgccgctccacggtgcaaacaggcgcaccagttccccgttcgcaagcccctgtttacaggcaaactgaggtaataacgccacgccattcaacacaaccagggcgcgaactcgctgagcgaaatgcattagcgcaaatccctgatcttttaagctgcgcgttaaccactgatacaaatgttacccgccaacggcttcggtatatgcaacccgacacaaaattgtgtcatagtgcaggaaaaagcatttaccaggagcagacaacagcaatgaaacgcccggactacagaacattacaggcactggatgcggtgatacgtgaacgaggatttgagcgcgcggcacaaaagctgtgcattacacaatcagccgtctcacagcgcattaagcaactggaaaatatgttcgggcagccgctgttagtgcgtaccgtaccgccgcgcccgacggaacaagggcaaaaactgttggcgctactacgccaggtggagctgctggaagaagagtggctgggcgatgaacaaaccggttcgactccgctgctgctttcactggcggtcaacgccgacagtctggcgacgtggttgcttccggcactggctcctgtgttggctgattcgcccatccgcctcaacttgcaggtagaagatgaaacccgcactcaggaacgtctgcgtcgcggcgaagtggtcggcgcagtgagtattcaacatcaggcgctgccgagttgtcttgtcgataaactcggtgcgctcgactatctgttcgtcagctcaaaaccgtttgccgaaaaatatttccctaacggcgtaacgcgttcggcattactgaaagcgccagtggtcgcgtttgaccatcttgacgatatgcaccaggcctttttgcagcaaaatttcgatctgcctcctggcagcgtaccctgccatatcgttaattcttcggaagcgttcgtgcaacttgctcgtcagggcaccacctgctgtatgatcccgcacctgcaaatcgagaaagagctggccagcggcgaactgattgacttaacgccagggctatttcaacgccggatgctctactggcaccgctttgctcctgaaagccgcatgatgcgtaaagtcactgatgcgttgctcgattatggtcacaaagttcttcgtcaggattaatccatcaaataacgcctgatagcacatatcaggcgttatcctcacttctttttgtattccttgaatcacatcacaaaatagacaaatctcaggcggcaaaaaacgacgtctgaatgcatttttttgctggcgacaaacccacgtaaaaagctcaccgtaagcgcaaataccctcattttgattgcgttttacggagcaaataatgtctaacgtgcaggagtggcaacagcttgccaacaaggaattgagccgtcgggagaaaactgtcgactcgctggttcagcaaaccgcggaagggatcgccatcaagccgctgtataccgaagccgatctcgataatctggaggtgacgggtacccttcctggtttgccaccctacgttcgtggcccgcgtgccactatgtataccgcccaaccgtggaccatccgtcagtatgctggtttctcgacagcaaaagagtccaacgctttttatcgccgtaacctggccgcccaccgaggctacgactccgataacccacgcgtggcgggcgacgtcggcaaagcgggcgtcgctatcgacaccggggaagatatgaaagtcctgttcgaccagatcccgctggataaaatgtcggtttcgatgaccatgaatggcgcagtgctaccagtactggcgttttatatcgtcgccgcagaagagcaaggtgttacatccgataaactgaccggcaccattcagaacgatatcctcaaagagtacctctgccgcaatacctatatttacccgccaaaaccgtcaatgcgtattatcgcagacatcatcgcctggtgttccggcaacatgccgcgatttaataccatcagtatcagcagttaccacatgggtgaagcgggtgccaactgcgtgcagcaggtagcatttacgctcgccgataggattgagtacatcaaagcagcaatctccgccgggctgaaaattgatggcttcgtccctcgcctgtcgtttttcttcggcattggcatggatctgtttatgaacgccgccatgttgcgtgcggcacgttatttatggagcgaagcggtcagtggatttggcgcacaggatccgtataacaacgttatccgcaccaccattgatcattgtgcacatcctatgtgtcgggattatctgcatcgctatctggaaaatgcgtccggcggacatattcaccacgatcttagccacgtcttcgacttacaccgtaatttaattgcaaccggatcgatgctgggttaatggtttgtcccgtcacgatcttcagcaatatgctgaagcatcgtggcggtataacgatgatttctgattgaataaagatattcctgcatatacatcggcctgtgcggcgcatcaaaatatttcagcgttgccggattcaccagtcgccaggcaaaatgcgggatcaccgtcagaaaatgtccccgctccacgtcgctgattttggccataaaactatagggacgataaataatggttggattgatcccacaaggacgcatattcgcatcaatcattgcttcgaagttagcccagttttgaaagcgcatttgtagccagggcagctcctgaagcagctcttgctcttgtcgctcttcataacggcgagaaacgagaaagcccaatcgcagcggcggtagttcactgatagtcaggttttccagttcctgaactcgtgcagatacatgctgtggggagattataaaatctaactgacggtcaaaaagattatcgataacgccatttgcgctgaactcaactggctgggcggtcacgccttcgtacttatctccgagactaatcaactgatcaaaaataatggtcggataagtattatctatgcctatcacaatgtctcgtgaacgacgtcctgagttatggatttcattatcaatcgcagaaagtcgttgataaaccgggaacagtttttgatacagttcctgtccggctttattgaggctgatattattatctttgcgggtaaatagcgtatagccaatttgttcttccagcgcggcaatgcttttgccaaatcgcgaagccgtcatatggattttttctgccgcccgggcaatattattggtttgcgctaataaaatgaaattgcgcatctttttcgaaataaaaatgtccatcccccctctcccgcatccttgtccgcttaaccgtttcagtcagcctatccttgatgaaaccgcgagcaaagataggtgattacgtcatggttttacagaaaaaggaggcaatatcgggtaaaggcattagcccgacgaatacgtcgggctacaagtattaatgtgcagcaggtgttttagcgggtggttgatccacaggttctaactggaagattacatcgacctgatcatcaaactgaatagcggcctgctcgtaagtttcctgggcggacaccggcgcggcatcggctttcatcatccgcaccattgggctgggctgatagttggaaacatggtagcgtacgctatataccggccccagtttacgatgaaagccgttcgccagttcctgcgcctgatgaatcgcgttatcaatcgctgccttacgcgctttgtctttataggcatccggctgcgccacgcccagcgacacagaacgaatttcgttaagacccgcctttagcgcgccgtccagcaaggaattcagtttgtctaactgacggagcgtgacttccaccgttctcactgcgcggtagcctttcaggatacttttaccatcctgataatcataatctggctgagtgcgtaagttcgctgagctgatatcttttttcgcgatctgattgagctcaaggaaggaaatgtattgtgcgacgcgctcatctgcctgtttcttggcagtagcggcatccttcgcggccacgttaacttcaatcgcaagagtggcaatgtctggcaccgcatccacgcttgccgtaccggaggtgacaatatgcggtccatccggcaattcgttagcctgcgctgccatcccgctaatacccattaatgccgccagggcgataactttgaacttcacgttagtctctccgtgttaattgacttgcccaaaattcaggacctctggaggcaagcttagcgcctctgttttatttttccatcagatagcgcctaactgaacaaggcttgtgcatgagcaataccgtctctcgccagctgcaaggcaataaaccacataacacatcccactaccagattgataatgcgctgtgattttgccgtgcgcaggcgcggtgccagccaggctgcgagaatagccagaccaaagaaccacaggaaagaggcgctaattgttccgagcgcaaaccaacgttttggttccacatcaagttgcccgccaaggctgcccagcacaacaaaagtatccaggtaaacatgcggattcagccaggtcactgccaacatggtggcgataattttccatctgccttgtttcaggacttcggcactggctaactcaatgttactgctcattgctgttttaaaagcgccaaaaccataccacagcaagaaggctacgccgccccaggtcagcgccagcaaccacggcgactgcatcaataacgcgctgccaccaaaaatccccgcacaaatcaggaccaaatcgctgatagcacaaagtaaggcaatcataatgtgatactgacgacgaatgccctgattcatcacaaaagcattttgtggaccgagcggtaggatcatagccgccccaagtgcaagaccttgaaagtaataagaaaacacgttggatattccgaattaagtatctgatgcagagactatatcgcgggattgttattagcggaaattgataatattaattggcaatcagaaaaactaataagagagaggccagagagtattatctggcctcagcgttgattacgcagctttgtcttctttcacccgcttaaagttcacatccatttgcgggtacgggaagctgataccggcggcatcaaattcacgtttaatacgctccagcacatcccagtacacgttttgcagatcgccgctgttgctccagacgcggaccacgaaattaatcgacgatgcgccaagttcgttcagacgcacagtcatttcgcgatctttcaaaatgcgatcttcagactggataatatcggtcaggatctgcttaacctgatcgatatcggaatcatacgccacgccaataataaattcgttacggcgagctggctcgcgggagaagttaataatattcccggcaataattttaccgttcggaataacgataattttaccgtctgcagtacgcatggtggtggagaaaatctgcacactcagcacagtaccggctacgccgccgaggtcaacatattctccggcacggaacgggcggaacatgacaagtaacacgccagcggccaggttagacagtgacccctgcaaagccagaccaacagctaagcctgcggcaccgagtacagcaatgactgacgctgtttgtacgcccacgcgccccagtgcagcgattagcgtaaaggcgataattccgtaacggactaatgcagaaagaaaatcagcaacagtggcatcgattttacgggagatcatcaggcgattcaccgcgttggaaatcatccgcgcgataatcaaaccaacgatgatgatcgcgagtgccgccacgatgtttactgcataacttagcagcagcgcctggttagccaccagccagcttcccgcgccgtttatgctatcgacaacattcaaatcttccattcaatattccttttcaactgactcaaaatggagaaatacactccgccgccttatgacgggcagtctgacaagggtaaacaataaagcataattttgccaaatagatcacagatttctcatctgtatcaccttgcttttggcgaaaaaaagacccgcagagcgggccttgagataagcagaaaggaatatcttacagaacgtcgatcgcgttcagttcctggaatgctttttccagacgagcgatcatcgaagtctgaccggcacgcagccatacgcgcggatcgtagtatttcttgttcggctgatcttcgcctttcgggttgcccagctggccttgcaggtaagcttcgttttctttgtagtagttcagaacaccttcccaggttgcccattgggtatcggtatcgatgttcattttcactacgccgtagcttacggaatctttgatttcctgagcagtagaaccggaaccaccgtggaagacgaagttcaggctgttgtgcggcaggttgtgtttcttagaaacatattcctgagagtcgcgcaggatggtcggagtcagaaccacgttacccggcttgtaaacaccgtgtacgttaccgaaggacgcagcgatggtgaaacgcgggctgattttgctcagctcggtgtatgcgtaatcaacgtcttccggctgggtgtacagtgcagaagcgtccatgtggctgttgtccacgccgtcttcttcaccaccggtgcaacccagttcgatttccagagtcatgccgattttggacatgcgctccaggtatttagagcagatttcaatgttctcttgcagagattcttcagacaggtcaatcatgtgagaagagaacagcggcttaccggtagcagcgaagtgtttttcacccgcgtccagcagaccgtcgatccacggcagcagttttttcgcgcagtggtcggtgtgcaggatcaccggaacaccgtagtgttcagccatctggtgaacgtgatgcgcaccagagatcgcacccaggatagcagcgccctgcggaacgtcagatttcacgcctttaccagcgataaaagaagcaccaccgttggagaactgaacgataaccggcgctttaactttagctgcggtttccagtacggcgttgatggagtcagtaccgacgcagtttactgctggcagtgcgaagttgttttcttttgctacctggaaaactttctgtacgtcatcaccagtgattacgccaggttttacgaaatcaaaaatcttagacatgtctcttgtcctgtatcgtcgggccttatactcgtcatacttcaagttgcatgtgctgcgtctacgttcgctcaccccaatcacttacttatgtaagctcctggggattcactctcttgtcgccttcctgcaactcgaattatttagagtatgaaaaagtgcgtgctctaaaagcgcgctgaaacaagggcaggtttccctgccctgtgattttttacttcttagcgcgctcttcgagcatcgctactgcaggcagtactttaccttctacgaattcgaggaatgcgccgccgccagtggagatgtaggagattttgtcagcaatgccgaacaggtcgattgctgccagagtgtcgccgccgccagcgatggagaacgcttcgctgtctgcgatagcgttagccacgatttcagtacctttgcggaagttcgggaattcgaacacgccaaccggaccgttccacagaatggttttcgcattcttcaggatttcagccagttcctgagcggaagcatcaccgatatccaggatctgctcgtcagctttcacatcgttaacagatttcagggtagccggtgcagtttcagagaactcggttgctacgcgaacatcagacggaaccgggatgttgcaggtggtcagcagacgtttagcttcgtcaaccaggtcagcttcgtacagggatttacccacatcgtggccttgtgccgcgataaaggtgttagcgataccaccgccaacgatcagctggtcagcgattttagacagggagtccagaacggtcagtttggtagatactttagaaccaccaacgatagccaccatcgggcgagcaggttctttcagtgctttacccagcgcgtccagttcagctgccagcagcgggcctgcgcacgcaacgtcagcgaatttaccgataccgtgagtagaagcctgcgcgcggtgagcagtaccgaatgcgtccattacgaacacgtcacacagtgcagcgtattttttggacagagtttcgtcatctttcttctcgcctttgttgaagcgaacgttttccagaacaaccagttcaccttcagcaacgtcaacgccgtcgaggtaatctttaaccagacgaaccgggttagacagtttgtctttcaggtagttaacaaccggcagcagagagaattcttcgttgtactcgccttcggtaggacgacccaggtgggaagttaccatcacttttgcgccttgtttcagggcaagttcgatggtcggcagagaagcacggatacgcgcgtcgctggttactttcccgtcttttactggtacgttcagatccgcacggataaatacacgtttcccagcaagatccagatcggtcatcttaattacagacatggtgaatcctctcgttgattctaaaagttttgcagacgctgcttgcgtcttacctgaaagcaacagtagccatagctaacgtcgtgtcgagcattcggttagcaaagccccattcgttatcgcaccagaccaacgttttgatcaggtgtgcgccactgacccgggtttgggtgccatcgacaatggcactgtgcggatcgtggttaaaatctacagagaccaacggcaattccgtatagtcaactataccatgaaatgcaccttgtgctgctttttgcagcaacaggttgacttcattggcttttacaggtttcttcaccgtcacgcttaaatcgattgccgtcacatttatggttggcacacgtaccgcaatcgcttcaaagcgatcgttaaattgcggaaaaaatcgtgtgataccggcggccagtttagtatcgaccggaatgatcgactgactggctgcccgagtgcgacgcaggtcaggatggtatgcatcaataacctgttgatcgtgcatggcggagtgaattgtggtcacagtgccggactcaataccgtacgcatcatctaacaatttgatgacgggaattatgcaattcgtggtacaggaagcgttagaaacgatgcggtgttccgcacgaagttgatcctgattgacgccataaacaacggtcgtgtcgagatcgttactgccaggatgtgaaaagagcacttttttagccccggcggcaatgtgtgcttcaccatgctcgcgggagccatatacgccggtgcagtcgaggactacatcaacgccaagttcacgccaggggagcgattgcagtgaacgttcatgcaatacacggatggcgtcatcaccaacaaaaagttgatcgcgttcctgtcgtacttcccatgcaaaacggccatggctggtgtcatatttcaacaaatgcgccatgcccgcagcatccgccagttcgttgattgccaccacggtaatttccgcacggcgtccggattcatacaaagcacgaaccacattacgcccgatgcgaccgaagccatttatcgctacgcgtacggtcatagatctcctgcaaggttttccctgagcaaatttgccagacagagtaatccagcaaatcgttcggggaaaccttacctgtcgcaaactgcgactgattggttaattgtcgaacatttaatcgactgaaacgcttcagctaggataagcgaaacgtggaataaaaggaatgattgtccagtcaaagaagacaattatctgacttacgtcacgttttcagccccgcccctgtggaatttattccactttgcagaatcacgaataagcgtagcaaaatcttttcgttgtgccgtcacaaaccctgacttatatcagaatatgactgatgcagcgtcgatattatccgcaatacgtccgagtttcggagtactccaatgatgacattgccctacccatattcttcctccgcacgcttttacgcgctgcgcctgctccccgggcaggaagttctctcccaattacgcgccttcgcgcagcaacaacaacttcacgccgcgtggattgcaggttgtaccggcagtctgactgacgtcgccttacgctatgccgggcaagaaaacactgccctgctaagcggtaagttcgaagtcatcgcattgaacggcacgctggaacagagtggtgaacatcttcatctctgcgtttccgatccacacggcacgatgcttggcggtcatatgatgcccggctgtaccgtgcggaccacgcttgaactggtgatcggctgcctggaggaactggcgtttagccgccagctttgcgcgctttctggttacgacgagttgcatatttcccccgttaaataactattttcagagaggttttcttatggcgcgtcgccacttttccagtcaggcactggtgttgatcgttatctctatcgccatcaatatgatcggcggacaactggccagcatggttaaattacctatttttctcgactccatcggcacacttattagcgcggtactgcttggtccggtgatcgggatgctgaccggtttactgaccaatttactctggggattgctgaccgacccgatcgccgccgcatttgcgcccgtcgcgatggtcatcggcctggtcgccggttggctggcgcgagcgggttggtttcgcaccctgccaaaagtcgttgttagcggcgtgattattacgcttgcggtaacggtcgtcgctgtaccgctgcgtactgcgctgttcggcggcgtgacaggaagcggagccgatttgttcgttgcctggatgcactcgatggggcaaaacctggtggagtcggtggcgattacggtgataggcgcgaacctggtcgataaaattctcacagcggtgattgtctggcttttactgcgtcagctgccgattcgcaccacgcgccattttccggcaatggctgccgtgcgctaaatgcatccgtttacatccttaacgctgtgggcgctggcggcctgcaccacgcttatcctgcccacacagacaatattgccagtctatagcgcggcgacctttttctgccttattgcgctaaaggccacgcggcggcgggcaaaatatgtcgtctggctgatgttctcgctgggggctggactgtggctggtgcacggtggctggctgacagaatggctaagcggcacgccacgctctccagaacggtgggcgcatgctattacgctctggttgcggattctggcgattgtttcaacctcacagttgtggatgcagtacgtccccgtgcaacgttttatccgcgctttgtttgcttctcgcctgccgccgggcgtcgcttatctgtttgccgggccgttattggtcgttgagcagttaaaacggcaattggcgattattcatgaagcgcagcgcgcccgcggcgtgccgctggatgagggctggtatcagcgtttacgtgcgatgcccgcgttaattattccgctaacacacaatgcgctaaacgatcttgctgtccgtggtgcggcactggatatgcgggcatttcgaatcaacaataggcgcactacgttatgggcaccagccgatagcaccctacaacgcgtagcacgttacgccatgatattgctaatgctggctgaattcggagcgtggatatggttacgttagaacagtttcgctattgcccgacacactcaacgcatcctccgttctgttatgactttcactatgtcaaaccggggatggtcgccatctttggtgacaacggcagtggcaaaagtacgctggcgcagctgatggcgggctggtatccggactttctaccaggagagataaccggcacggggacgcttctcggtacgcccattgggcgtctcccgcttaatgaacaatccgccaccatccagctcgtccagcaatcgccctatttgcagctctccggctgtacctttagcgtggaagaagaagttgcctttgggccagaaaatctgtgtcttgctgaaaaagagattatggcgcggattgacgccgccctggccctgaccgagtgccagccgttgcgccatcgtcacccggcaacactctccggtggagagacacagcgtgtggtcatcgcctgcgccatcgcgatgcagccaaagctcttaattcttgatgaagcctttagccgcctgacgccgcaggcccgcgaaatgctgttgcagcgcttacaacactgggcgcttgaacgtggttcgctgattattctttttgaacgtcatcacacacctttcctgaaccactgccagcaagcgtggcaattgcaaaacggagcgctccagccactatgttaacgttaaatcagatatcttatcgctggcctggcgcggctacggattgtctttgcgacatttctctgcaactcaaacaaggtgaatggctggcgctgaccggcgacaatggcgcgggaaaatcgacgctgttacgagtaatggcaggtcttcttacgcccacagccggtacggttatgctgcaacaacaagcgatgaaaaacctgaaaaaccgccagcgcgcggcaaagattggcgtactgtttcaggaagcggaaaatcagctttttcacagcaccgttgctgacgaaatcgcatttggtttgatactgcaaaaatgcccggcggatgaaatcactcaacataccaatgctgccctgcaatgctgtcagttagcagacactgccagcgcgcatccgttagatctgcatagtgcgcagcgacggatggtcgccgtcgcctgcctggaagcactctctccgccactattgctactggacgagccgagtcgggattttgacgaaaattggttgagcgtgtttgaaagctggctggaaaagtgccgccagcgaggcacgagcgtcgtagcaatcagtcatgacgccgcatttacccggcgtcatttctctcgtgtggtgcgactggaagatggtgtaatcaggaacgttaatccatcagacgatattcacccgtagcggtcatcattaaggtcaaatttgcaggcagactctcttccagcacccggcgaacattcggcccgtcggtacggtcataaaaggcttctgcgtctgccagcgataaccctcccgccagcttgcgccccaccagacgctcccgcaacgcagatgcgggagctttgataaagatcgagaaatcacaaaattgcgcaagctggcaccacttctcgtcgtccaacaacaaccagtttccttcgacgatgacgagtggtgcggtaacgtgcaacacatcttcaacaggatcatgcttttgtcgatcgtactgcggccacgtacaatccccttccacaacccggcacagattttccgccagtttcgcaacgttgaatgtctctggtgcgcctttgaagggtcgcaattgatgcacatccagccagctattgtaatggtgaaaaccatccatcggcagcgtctgaatagcgggcagttccgggtcttgttgcgcgagatattcccagaaggtggttagggtagatttacccgtccccggcggagcgcaaagaaaaaccaccgtacgccgctgcggatttactgtctgtaaggccgccagcatacgcagcaatggtttatgtacattttcaatttcatcatcagagtactgcgcctgtacctttagtccattcaccgtcagttcgattttcacggcgttaattcctttaaggtggtcgttactgccagcatcagcgccgttttgaccatcccgctaaaacgcgcctctgaccagacggcgaaatcggcgaatttcatcgctttcaacgcgtcatagagactcgcattgcggattatgctattgacgttgctgataaaatcccaggccatgtcatcggcaaatccgggcgtttcatcctgttcgttcaggtaatgccaaaactgggaaaaatgcgtgatatcggcgtacagccatttatccattttccccagcgcataaatcaaacgcagcgcaacatcaatatcgtcaagcgggccgctttgggcgagtaacggcttcactgcatattcgacgatctcttcatcgttatcgacaaacagcgacggcagaaactggcgtatcccctggagcaaaatagaatgcgcagttttcataaatgaaaataaattgtcctgtgcatccagttgctcaagcacatcatcttctgtcagcgtcgccattggtcttccgatagatcaccatcaatgcagggagtctattatattacacgtttggtccgcgccgccgatcagtaatgtctgcgtccgcaccccattcgccgtctgttggataccgttcaccaactcgccgcccgtcacgcccgtagcgctaaagaggatatcgttccccctcgccgataaccactcgcccacgaaaagcaacgtcgtttaatgcctggcgcatcgcggtgaccgcaaggctatcaattttatttttgtcgccacagccggtttgcggccaggcagccaacgctgcctgttccgtaacgcgaaataatggccacgccagggacatcattgcgcggcctccccaatatcaacgccaaattgtgccagcagatatttctcggcctgttcattccagatgccgtgcgttttctcaaccagccgcgccagctctttaaacagcggatcggttttgcctttttcggcaaaatcggcaatggcggtcagcggcatggtcacgccgttataaatgagttttttaccgccagggatatccggcagattgagcacggtttctggcaccgcatccaggccaccgatatgggtcaccataaacgacggctgtaactgccccgtggcgctaagggcaatcgcctctttcatgtcgtccgtggaaccgccggacgtgccgacaacgtgcgtactgttgtaatggacgttgtagaaattaaacggcactttgaagtttttatccgtcggaccggcaaagaagttcaggcagccatcttccgccagtaattcatccgccatctcgacgactgaaggcaccgctgcatagacaaatacgtcatcaaatccggcatcatccgtcagcgcccgcagcgtctggaccggatcgctcacccctttggtattcatatacaccagctcaatgcctttactggccgccagttccaccggcagcagcatctgcacctgcgccagccgtttgtcgtcgatatcgactaccaccacccgcgacggttgtatgccgccgttaatagcgtaatcgatagcgccaattcccatcgggcctgcacacgccagtagcgcaatattgccgccaggtttgacgcccatacgatgctcataaacatattgcgtggtgtgataattggcatgataagcgccaataatgcagcacatcggttccgccagcgaggccgcagcaaaataagagccgtgatacggtaatacacagcctaaattaatcgcgatttcgggaataatcatataggtggcgttaccgccaaaatattcgtagctgtagcccgctgaatacccgcctggtaaccccatcgccggttgcaatacaaaacgctggccttttttatatttgccagtgagatttttacccacttcgacaataaccccggcacattcatgcccggtaatgaccggatgattttctaaatcgtcggggacgcgtttatgttcactaccgagtaacgccgctttccaggtggataaacaaacgctgtcagaaattacattcactaacagttcattatcggtaatttctggcagctcaaattcgcgcagacggacatcccgcttgccataaatagcagcaactttggttttcatttttacctctgtaatcagtgtttatgttcagcggttaattgattaaataaagtgtcgagttttggatcgccaatatagttattaatcaatatcagtggtttatccgtcacacgtttcacgcgcccttccagactggcgtgagtaacgacgatatccgcatccgcaggcacgttttctatggcgtaatgttttacttctattgccagccccgctttttccaggcgtttacggaaggtggttgcgcccatcgcactggagcccatccctgcatcgcaaacaaaggcaatacgcttaacacggcttaacgagaatgcaccttcttgtttcatcgccttaaccgcattggctgactgagcaaactcatcgtcgctctccgtttccaccgttttttccatcttcagtatcagcgaagtgatagcaaaggacaccagggtacctaccgtaacaccggcaattgtcgccaggaacgagcctttcggcgtcagtgccaggtaagcaaagatagaccccggacttgggccagccaccaaaccaccgtccagtaagttaaacatccaggtgccagacataccgcccgcaatcatggcaataatggtcagcggcttcatcagcacatacgggaaatacagttcgtggatcccaccgaggaagtgaataatcatcgccccgggcgcagaacgtttactcatccctttaccaaacaaggtaaacgccagcagcagccccagaccaggacctggattggaggccaccatgaagaagatggatttaccgttaaccgaagcctgttgcattcccagcggataatagacgccctgatcgatcgcattattaaggaaaagcactttcgccggttcattgatgactgacagcaaaggtagataacccgcatgtaccagcgcctcaatacactctttgacgaaagtattagcaattaacaccgccgggccgatcacttcaaaacccagcagacaaaggagcatccccgcgatacctaatgagaagttattgataaccatctcaaaaccggcaggtatgcgtttttccagcgacttgtcgatatatttaatcaccagaccaccgagcggccccataatcatcgagccaaggaacatcgggatttcagcgccgacgatcacaccaatcgtaccaattccgcccatgaccgcgccgcgtttaccgccgaccagatgaccaccggtagaaccaatcatcacgggcaataaataggtaatcatcggaccaacaattttggcgaaatgttcattcggcagccagccggtgggaataaataatgccgttataaaaccccaggcaataaaagcaccaatattggggatgaccattgcagtcaaaaagcccccaaaagcctggacctttgcacgagcagacttgttttccataatattatcctgtagaggagagagtaattatccgcggctgataatgcccgctaattgtttttctgatgatgcggttaagagttgttcgagtatttcttcttcgcacagtaattcacttaacgcctgaatagcagcaatgtgcgaatcggcatcggcagcagaaagtccgatgagtaatttaatcggttcgtcattccccggaaaataaacgccttgtttaagtaacgtcaaagacatcccggttttaagcgctccacattccggtcgcgcatgaggcattgccacgcctggtgcgagaatataataaggaccattgctgatggtggaatctttaatagcctgaatgtaattctcgctgatatagttttttgctaacagtgatgccatcgagaaattgatagcttcctgccagtcttttgttgaatgtataactgagattgataattctggaaaataatcaataagccgcataaattatccttatttatttttagggtaccgtccggcggtaaaaataaaatacgcgtacaaattaacgaaagcaattggacacatgaaaggagaaactccacgagcaaaaataacaaaatattaaataacaacaacatgaaataagtttttaaaaagtcaattataaatctgttaagtaaactacaaaatcaacaaattattcatcactatatttgtgatacacatctctattttcttattgaatgttcgaaaacatacttattacgtttattattttttcgctcatcccctttataaattctgaattatcggctgttgtctgttttctcatcaccccatgtgacatattcctatactttactcaaggaagattcatatgaaagcacctgtttcattaacctcatttcgcccacaaaaatctcttgctatcgccattggcgtgcttgccgtggttgtgctgccatttctctcgtattacaccgttaatgaaggtgaacgcggcattttgctgcgctacggaaaaatcgtaaaagttgccgagccggggctgggttttaagatcccttttatggaaagcgtagagaaaatttccacgcgtaatcaggctgtggtctatcagggattacaggcctacagccgcgaccagcaaccggcacaaatgacagtatcagtcagcttccacattaaaccttcagaagcaggcgcggtttataccacctacaacaccattgaagcattaaaagatcgtctgattgtccgtcagttgccaactcaactggagaacgttttcggacaatataccgccatcagcgccgtacaggatcgtacaaaactggttcaggatctgcaaaatgccatgcgcaaagccgttgttgggccagtggtaattgacggggtccagattgaaaatattgatttttctgacgcttatgaaaagtcgattgaagaccgaatgaaagcagaagtcgccattgccacgcgtaagcaaaatctggaaacggagaaaatccaggcgcaaatagcggtaactcaggcccaggcggaagcagacagtaaactagcggcagccaaagcagaagcggaaactattcgcgtaagaggcgcggcagaggctgaaactattcgtttaaaaagtgcggctgaagcagaagctatccgcctgcgcggtgaagctctgcgggagaatcccggacttgttgccctcaccactgctgagcgttgggacggtaaactgcccgataccatgatccccggcagcacagttccgtttatctctactaagtaaaaaaagggccgctttcgcggcccttgagattgatagcaaagacaaaactgcctgatgcgctacgcttatcaggcctacatacttcctgcaatatgttgaatttgcaaaatcttgtaggacggataaggcgttcacgccgcatccggcataaacaacgcgcactttgccaacaatctgaagggccgcatttgcggcccttctcacaaagcatcttaccgattacagcagcgcttttgctttcgcaacaacgttgtcaacggtgaagccgaactcttcaaacagctgctctgccggagcagattcaccgaaggtggtcatgccgacgatagcgccgttcaggccaacatacttgtaccagtagtcagcaatgccagcttccaccgcaacacgagcggtaaccgctttcggcagtacggattcacggtaagccgcgtcctgcttgtcgaatgcgtcggtagacggcatggaaaccacgcgcgctttcacgccttcggcagtcagtttttcgtaggcggcaacagccagttcaacttcagaaccggtcgcgatgaagatcagttccggctgaccagcacagtctttcagcacataaccaccgcgcgcgatgtttgccagctgctcttcagtacgttcctgctgcgccaggttctgacgggagaggataagcgcagtcgggccgtcctgacgctcaacgccgtatttccacgctactgcggattcaacctggtcacacggacgccatgtagacatgttcggggtcacgcgcagagaagcgatctgttctaccggctggtgagtcgggccatcttcgcccagaccgatggagtcgtgggtgtaaaccatcacctgacgctgtttcatcagcgcagccatacgtacggcattacgtgcgtattccacgaacatcaggaaggttgaggtatacggcaggaaaccaccgtgcagggagataccgttagcaatcgcggtcataccgaactcgcgaacaccgtagtggatgtagttacctgcagcatcttcgttgattgctttagaaccagaccacagggtcaggttagacggagcaaggtcagcggagccgccgaggaattccggcaacagcggaccgaacgcttcgatagcattctgagacgctttacggctggcgattttcgccggattagcctgaagtttagcaatgaactctttcgctttcgcgtcgaagtcagacggcatttcgcctttcatacggcgggtaaattcagcggcttcctgcggataagctttcgcgtaagcagcgaatttctcgttccatgcggactctttcgcctggcctgcttctttcgcatcccactgagcatagatttcagacgggatttcgaacggcgcgtatttccagcccagctgttcgcgggtcagggcaatttcagcgtcgcccagcggcgcaccgtgggagtcgtgggtaccggctttgttcggggaaccgaaaccgatgatggttttgcacatcagcagggacggtttgtcggtcactgcgcgcgcttcttctattgcgcgtttgatggatgccgcgtcatgaccgtcgatgtcgcgaataacgtgccaaccgtaagcttcgaaacgcattgcggtgtcgtcggtaaaccagccttcaacgtgaccatcgatagaaataccgttgtcatcgtagaacgcaatcagtttacccagcttcaacgtacccgccagagagcaaacttcgtgggagatgccttccatcatgcagccgtcgcccatgaaggcgtaggtgtagtggtcgacgatgtcgtggcccggacggttaaactgcgccgccagcgttttttctgcaatcgccataccgactgcgttggcaataccctgacccagcggaccggtggtggtttctacacctgcggtgtaacccacttccgggtgacccggagttttcgagtgcagctgacggaagtttttcagttcttccatcggcagatcgtaaccggtgaggtgcagcaggctgtagatcaacatggagccgtggccgttggacagcacgaagcggtcacggtcagcccaggacggattctgcgggttgtgtttcaggaaatcacgccacaggacttcggcaatgtcagccatacccataggggcacccgggtgaccggatttggctttctgtactgcgtccatgctcagcgcacgaatagcattggcaagctctttacgtgaggacattttgactccagatcggatgatgaagggcacgcccttaacgacttgacgacagcgcgttttgggctacgccggaaaatttgccaacaatttaccgcaagccgctcgtcatgtacatggaacatccttttgccgcttcagaaatctctggatcatgctcgcatgttgcgcaatccactcgcccgtccgctgcgcttttccttatactgagactgagcgtcgattcacctgcaaacggcgcatttttagaataatcctgaccttgtgcggaagagaaaacatgaaaattcgcgccttattggtagcaatgagcgtggctacggtgctgaccggttgccagaatatggactccagtggactgctctcatcaggagcggaagcttttcaggcttacagtttgagtgatgcgcaggtgaaaaaactgagcgatcaggcatgccaggagatggacagcaaagcgacgattgcgccagccaatagcgaatatgctagacgtctgacgacaatttctcgcgcgttaggcgataacatcaacggtcagccggtgaattacaaagtgtatatggcgaaggatgtgaacgcctttgcaatggctaacggctgtatccgcgtctatagcgggctgatggatatgatgacggataacgaagtcgaagcggtgctcggtcacgaaatggggcacgtggcattaggccatgtgaagaaaggaatgcaggtagcacttggtacaaacgcaattcgcgttgcggcggcctctgcaggcggaattgtcggcagtttgtcacaatcacaactgggagacctgggcgaaaagctagtcaattcgcaatttacccaacgtcaggaatcagaggccgatgattactcctacgatttgctgcgccaacgcggtatcagcccggcaggtcttgccaccagctttgaaaaactggcgaagctggaagaaggccgtcaaagctcaatgtttgacgaccatccagcatccgccgaacgcgcccagcatattcgcgatcgtatgagcgcggatggagttaagtaaagccaggtagtgccgaacgtaggtcggataaggcgttcacgccgcatctgacaagaatggcacatttgttactccgtgcgcattgccggatgcgatgctggcgtatcttatccggcctacgggtgccgagtgtaggtcggataaggcgctcacgccgcatccgacattaatgacacatcacccgtgcgcctcttatctggcgcttactctccctttttcgccgcctgaatatacagcatctccagcgccagcgtcgccgcagccagagcggtgatttccgactgatcgtatgccggagccacttccactacgtccatcccaacgatgttgagatctttcaagccgcgtaccagtttaatggcgcgatcggaggtcaggccgccaattaccggcgtaccggttcccggcgcgaaagcaggatccaggcagtcgatatcaaaggtcaggtaaaccggcatatcacccacaatctgtttcacctgggcgataatgtcatccacgctgcgatcgttcacctggcaggcgtccagcacggtaaagccgttgtctttatcaaactcggtacgaataccaatctgcacggaatgattcgggtcgatcagaccttctttcggcgcggtatagaacatggtgccgtggtcaaattcacaaccgttcgcataggtgtcggtgtgggcgtcaaagtgtaccagtgccattttgccgaaatgcttcgcatgagcgcgcagcagcggcagcgtaacaaagtggtcaccaccgaaggagagcatacgcttaccagcagccagcagcttctcggcgtgcgcctgcagcttctcgctcatctcacgggcatcgccgaaggcatataccagatcaccgcagtccacgacgttcaggcgctcacgcatgtcgaaattccacgggaagcggttgtgttcccaggccagattcgtcgaaacctgacggatcgctgccggaccgtggcgcccccccgcacggccagaagtggccatatcgaacggcacgccagtaatcacccagtcagcatcgctgtcatatggctggaagttcatcggcaggcgtaaaaaaccaaaggcgttggaaaccagtgagttatcgtattgatgacctaaggtgctcatggatggactcctattacaaagtcgatataaaaaaacccttccgcgtcgttaggcccgacgaggaagggttggatttgtgaaacacaagtttgtgctaattatcgccttaaatgggcgaggcatcaagcgaggttgctatttccgacacggtggcggcgcatagccattgttatctgccggaaaggcttgtccagagcacggcggcagcgcgtttttcgccgggccttgtaattcaaaggcggcaaagccgattacaccggtattacgcacatcgccttgcgccgaattggctgcgtaggaatcagcaacgttggcgaactgaaaagccgcttcggtatgtttatctttgcggaatcctttaatcgctaacgaatctccggcattcacaatataaccgttgttattcagcgaaccttgtttaccattcagaacatccaggccatcaaccgtagcaacgatctcgtagttggtgttacgactgtaattacggacatataattgataattcattccgactctggcatggacaatatagcgtggttcattattggatgaatcataaacccgcgtaattggtagagatttaaaattaccatcgcgaatagcatattccagttcgttaatacgaatgctataaacgcggtcgtagccggaaggaacattagtcgaataactaataacgatcatctctgccggatcgcgccaggctcgttcagcagatacgccatgaaccgttgagtgcacatccccaccccaggcggtgccgacattacccgatgcactgctattatactgcgcattactggaacaaccggccagcagcacgattaatgccaccaacgcgctacgtactttccattttttcataaccgttccctctgcatttaattaatgcagcgattgtagggagattatttaataagaaaagcagctaaattatttttaagaatatataaaaagaaagcggggcgatttacttaaataaatcgccccgccagcggaataatcttaattattcatcttcaagataggtataaccgtacaaacctgcctcgaactcttcaaggaactgttgttgcagttcagcatcaagatcggttttcttcacctgatcgcggaactgggttaacagcgttttcggatcgagctgcacatattgcagcatgtccgccacggtatcgccttcgtcagacagttctacctctacgctaccatcagggaagacgaacacgtcaaccgcttcggtatcaccgaacaggttgtgcatgttgccgaggatctcctgatatgcgccgaccataaagaaaccgagcatcggcggattctccggatcgtactccggcataggcattgtcgtggcaataccgtcaccatcaatatagtggtcgatagcaccgtctgagtcacaggtaatatccagcagcacagcgcggcgttccggcacttgatccagcccttccagcggcagaaccgggaacaactggtcgatcccccacgcatccggcatcgactggaacagcgagaagttgacgtacattttgtccgccatacgttcctgcagctcgtcgataatcggacgatgagcacggttttgcggatccagctgcttttgcacttcatggcacatgctcaaataaagctgctcagcccatgcgcgttcttgcaggctaaaggtgccggaagagtagccgatatgaatgtcgtgcagatccatctggctgtcgtgtaaccattcacgcagagaacggcgagttcccggttcgtgcatttcctgccaggtttcccacatgctttgcagggcgcgcggtgcgtcttctgcaggcgcggtcggcaccgtgtattcgttacgttccacgccgatgatattcgacaccagcacggtgtgatgcgcagtcaccgcacgacccgattcggtgattaccgtcggatgtggcagaccattttcttcacacgcatcaccaatcgcccagatgatgttgttggcgtattcattgaggccgtagtttacggagcagtcagactgagaacgggtgccttcatagtccacgcccagaccgccgccgacgtcgaagcactgaatattgacgcccagcttgtgcagttccacatagaaacgcgcggattcacgaacgcctgtcgcgatatcgcgaatattcgccatctgcgaaccgaggtggaagtgcagcagttgcaggctgtcgagacgcccggcttcacgcagcgtttcaaccagttgcagtacttgagtcgccgccaggccaaacttcgatttttccccgccggaggactgccatttacccgagccttgcgacgccagacgtgcacgcacgcccagacgaggaacgacattcagacgttctgcttcatccagcacaatggcaatttctgacatcttctcaatgaccagatagaccttgtggcccatcttctcgccaattaatgccaggcggatatattcgcggtccttataaccgttgcagacgatgacgctacgggtcatgccagcatgtgccagcaccgccatcaactcagctttggaaccggcttccaggcccagcggttcgcccgaatgaatcagggactcaatcacgcggcggtgctggttaactttgatcggataaacgaggaagtaatcgccgttatagccgtaggattcccgcgctcgtttgaacgcggcgttaatggaacgcaaacggtgctgcaggatctgtgggaaacagaacagtgcaggcagacgctgaccctgtgcttcgcgagttttcactaactgcgcgagatcgacgcgagcttccgggacgtccgggtccgggcacacgctgatgtggcccagctcgttaacgtcatagtagttattgccccaccaggcaatattgtaagtacgcagcatcttgctggcttcctgggagctcattgcaacctcctgcatggagcgtagtacaccgtgttcgcccgctgacgaaggcaaacccatagacatgtcgtcagacatagcgaacctcaaattattttattaagtgtaaaacagttaacgactatcgcagcctggaactgcgataacaacccataagcacatggattttccagcagtgaatgctgacgctccaactgcgcaaccggtttctttttcataacattattaagcacataaccgaacgtaagtgtgacagttcggcgaaaccacgagaaaactcttgtttttacaagagcgcccttgttcagtcctcagtagctgtaaccagctcttgaatcctgagaagcgccgagatgggtataacatcggcaggtatgcaaagcagagatgcagagtgcggggaacgaatcttcaccagaacggtgagacaggttaagcagcagacaacggttcattatttcgtatcacctccacggccgcctgttaagacgaacccacaagccaaaactctgttttcaacccggctggaagtggcaacacgaaagaaacgtcgtgtgctttttatttaagccgcgcgccgcgttttataccccacaatggcagaaaattgcaaaagataaatacgcagaatgccagcattgtcaggaaaaatttccagccacgtttttaacagaatgagacacgattcaaaaaaaagtggaaattgggtgaagaactgacctaaaatagccatccagatgttaatccatccataccgattaacactcagactgccagtgtttttaacctgcagagtcgtggtaggatccgctaccacataaaatccacacaacagtttgagctaaccaaattctctttaggtgatattaaatatggcaaaacacctttttacgtccgagtccgtctctgaagggcatcctgacaaaattgctgaccaaatctctgatgccgttttagacgcgatcctcgaacaggatccgaaagcacgcgttgcttgcgaaacctacgtaaaaaccggcatggttttagttggcggcgaaatcaccaccagcgcctgggtagacatcgaagagatcacccgtaataccgttcgcgaaattggctatgtacattccgacatgggctttgacgctaactcctgtgcggttctgagcgccatcggtaaacagtctcctgacatcaaccagggcgttgaccgtgccgatccgctggaacagggcgcgggcgaccagggtctgatgtttggctacgcaactaatgaaaccgacgtgctgatgccagcacctatcacttatgcacaccgtctggtacagcgtcaggctgaagtgcgtaaaaacggcactctgccgtggctgcgcccggacgcgaaaagccaggtgactttccagtatgacgacggcaaaatcgttggcattgatgctgtcgtgctttccactcagcactctgaagagatcgaccagaaatcgctgcaagaagcggtaatggaagagatcatcaagccgattctgcccgctgaatggctgacttctgccaccaaattcttcatcaacccgaccggtcgtttcgttatcggtggcccgatgggtgactgcggtctgactggtcgtaaaatcatcgttgatacctacggcggcatggcgcgtcatggtggcggtgcattctccggtaaagatccatcaaaagtggaccgttccgcagcctacgcagcacgttatgtcgcgaaaaacattgttgctgctggcctggccgatcgttgtgaaattcaggtttcctacgcaatcggcgtggctgaaccgacttccatcatggtagaaactttcggtactgagaaagtgccttctgaacaactgactctgctggtacgtgaattcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgtgatgctgccggtctgaagtaatctttcttcacctgctttcaaaggccagcctcgcgctggcctttttcttttacctcaccgcggtggacaggcattcacgccgcatccgacaaaaaaaccgcccgcacaataacatcattcttcctcaacacgttttaccgcaaattatcatcactactgaaaccgattacaccaaccacgccagccaaatatttgtaatattttcatattattattcagccttcacagttgttacattttttttcagtaaagtcttaattgcagataacagcctttaatctatgatgatataactcaattattttcatgcacttaaatcataactaagataaatattagtgtaagcgattacactgatgtgatttgcttcacatctttttacgtcgtactcacctatcttaattcacaataaaaaataaccatattggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattacagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaatcctgtttgttgccggttcactgttctctgcggctgcgccaaacgttgaagtactgattctttcccgcgttctgctggggctggcggtgggtgtggcctcttataccgcaccactgtacctgtcagaaattgcgccggaaaaaattcgcggcagtatgatctcgatgtatcagttgatgatcactatcgggatcctcggcgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaacagcaacttccgccgcgcggtgttccttggcgtactattgcagataatgcagcaattcaccgggatgaacgtcatcatgtattacgcgccgaaaatcttcgaactggcgggttataccaacaccaccgagcaaatgtgggggacagtgattgtcggcctgaccaacgtacttgccacctttatcgcaatcggccttgttgaccgctggggacgtaaaccaacgctaacgctgggcttcctggtgatggctgctggtatgggcgtactcggtacaatgatgcatatcggtatccactctccgtcggcgcagtatttcgccatcgccatgctgctgatgtttattgtcggttttgccatgagtgctggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgctgctctgaacgtactgtttatcctgctgacattgtggctggtaccggaaaccaaacatgtttcgctggaacatattgaacgtaatctgatgaaaggtcgtaaactgcgcgaaatcggcgctcacgattaatctcctcaggcttcctcccgtcgcggaggaagccacctcttgcagtcatcttttcttcgctctatcctctgccgctatgaaaacatcccgtctccctatcgccatccaacaggccgttatgcgtcgcctgcgggaaaaactcgcccaggcgaacctgaagctagggcgtaactacccggagccaaaactctcttacacccagcgcggaacctctgccggaacagcctggctggaaagctatgaaattcgcctcaatcccgttttgctgttggaaaacagtgaagcctttattgaagaagtggtgccgcacgaactggcacatttgctggtatggaaacatttcggccgcgtagcgccacatggcaaagagtggaagtggatgatggaaagcgtgctgggcgttcccgcccgccgtacgcatcagttcgaactgcaatccgtgcgccgcaacaccttcccctaccgctgcaagtgccaggagcatcagcttaccgtacgccgtcataatcgcgtagttcgtggcgaagccgtctatcgctgtgttcactgcggcgaacagctggttgcgaaataaccacctgaactatcagaaactttcctgatctggctgattgcataccaaaacaactttcgctacgttgctggctcgttttaacacggagtaagtgatgtaccgttatttgtctattgctgcggtggtactgagcgcagcattttccggcccggcattggccgaaggtatcaatagtttttctcaagcgaaagccgcggcggtaaaagtccacgctgacgcgcccggtacgttttattgcggatgtaaaattaactggcagggcaaaaaaggcgttgttgatctgcaatcgtgcggctatcaggtgcgaaaaaatgaaaaccgtgccagccgcgtagagtgggaacacgtcgttcctgcctggcaattcggtcaccagcgccagtgctggcaggacggtggacgtaaaaattgcgccaaagatccggtctatcgcaagatggaaagcgatatgcataacctgcagccgtcagtcggtgaggtgaatggcgatcgcggcaactttatgtacagccagtggaatggcggtgaaggccagtacggtcaatgcgccatgaaggtcgatttcaaagaaaaagttgccgaaccaccagcgcgtgcacgcggtgccattgcgcgcacctacttctatatgcgtgaccaatacaacctgacactctctcgtcagcaaacgcagctgttcaacgcatgggacaagatgtatccagttaccgactgggagtgcgagcgtgatgaacgcatcgcgaaggtgcagggcaatcataacccgtatgtgcaacgcgcttgccaggcgcgaaagagctaacctacactagcgggattctttttgttaacccctaccccacgcgtacaaccgcgtggggagacgacgcggatttttaactatgcgtatcccccgcatttatcatcctgaaccactgaccagccattctcacatcgcgctttgcgaagatgccgccaaccatatcgggcgcgtactgcgtatggggccgggacaggcgctgcaattgtttgacggcagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagctccagcagtggcagaagattgcaattgctgcctgtgagcagtgtggccgtaaccgggtgccggaaatccgtccagcgatggatctggaagcctggtgtgcagagcaggatgaaggactgaaactgaatcttcacccgcgcgccagtaacagcatcaatacgttgccgttaccggtcgaacgcgtccgcctgctgattggcccggaaggcggtttatcggcagatgaaattgccatgactgcccgctatcaatttactgatatcctgttgggacctcgcgttttgcgtactgagacaactgcgctcaccgccattaccgcgctacaagtgcgttttggcgatttgggctaacggagaagaataatgatcaagctcggcatcgtgatggaccccatcgcaaacatcaacatcaagaaagattccagtttcgctatgttgctggaagcacagcgtcgtggttacgaacttcactatatggagatggccgatctctatttgatcaatggtgaggctcgcgctcgtacccgtactttgagcgtcgaacagaactacgataaatggtacgagttcacgggtgagcaggatctgccgctggccgatctcgatgtgatcctgatgcgtaaagacccgccgtttgataccgagtttatctacgcgacctatattctggaacgtgccgaagagaaagggacgctgatcgttaacaagccgcagagcctgcgcgactgtaacgaaaaactgttcactgcctggttctctgacttaacgccagaaacactggtcacgcgcaataaagcgcagttgaaagcgttctgggaaaaacacagcgacatcattcttaagccgctggacggtatgggcggcgcgtcgattttccgcgtgaaagaaggtgatccaaacctcggcgtgattgccgaaaccctgactgagcatggcactcgctactgcatggcgcaaaattacctgccagccattaaagatggcgacaaacgcgtgctggtagtggatggcgagccggtgccgtattgcctggcgcgtattccgcaggggggcgaaacccgtggcaatctggctgccggtggtcgcggtgaacctcgtccgctgacggaaagtgactggaaaatcgcccgtcagattgggccgacgctgaaagaaaaagggctgatttttgttggtctggatatcatcggcgaccgtctgactgaaattaacgtcaccagcccaacctgtattcgtgagattgaagcagagtttccggtgtcgatcaccggaatgttaatggatgccatcgaagcacgtttacagcagcagtaacccaccttagcgagaaggatctcgttgagactctgagtgacagcgcccttctttccacgcatactgggcgctgttgcttttttgaaccaggaaacagaacctctgacaatgaatttacagcatcactttcttattgccatgcctgctctccaggatccgattttccgtcgttccgtggtctacatttgcgaacataataccaatggtgcaatggggatcatcgtcaacaagccgctggaaaatctcaaaattgaagggattctggaaaagctgaagatcacgccggagccgcgtgatgaatcaatccgtctggataaaccggttatgctcggcggtccgctggctgaagatcgcgggtttattttgcatactccgccctccaattttgcttccagcattcgcatttcagacaacacagtgatgaccacttcccgcgatgtgctggaaacgctcggcaccgataaacaaccgtctgacgtattggtggctctgggttatgcctcctgggagaaaggtcaactggaacaagaaattctcgataacgcgtggctaacggccccggcagatctgaatattctgttcaaaacgccgattgccgaccgctggcgcgaggcggcaaaactgattggtgtggatattctcaccatgcctggtgtggcaggacacgcctgatgagtggaaccttactcgccttcgacttcggcaccaaaagcattggcgtagcggtcggccaacgcattaccggcaccgctcgccctttgcctgcaattaaagcgcaggacggtacgccggactggaacattatcgagcgtttactgaaagagtggcagccggacgaaatcatcgtcggtttgccgctgaatatggacggcaccgaacagccgttaaccgccagagcgcgtaaatttgccaaccgtattcatggtcgtttcggtgttgaagtaaagctccatgacgagcgtcttagcaccgtggaggcacgttccggtctgtttgaacagggcggctatcgggcgctcaacaaaggcaaagtcgactctgcctctgcggttattattctcgaaagctatttcgagcagggatattaaggcgatttactagcgcacagatttctgacaatgtgctcgttgtttcatgttggatgcggcgtaaacgccttatccaacctacagtgagtgcgaattcaaagttacgcttcccttgtaggcccgataagcttgcgcatcgggcatatttacaattcgtatcagacacagtaacgtcacaagcgcccttctttcacccgctgctgataactctgctgaaacgttatcatccccacctgctgcccggtttgaataacatgcggtaactggtgggttttcccttcacgaatcaaattccccaccgcgggtgtgttaatcagtaattcaaacagcgccacgcgtccttcctgtttatccacttccagtttttgtgacaacactgcccgtaaactacctgccagttgattacgcacgggatctttttcctgcgcaggaaatgaatccaccagtcgctcaactgcctgcgctgcgccgcgcgtgtgtaatgtcgccagcaccagatgcccggtttctgccgccgtcagcgccagacggattgtctcgctatcacgcagctctccgagcaaaatcacatcaggatcttcccgcaatgcagcccgcaatcccgatgcgaaagtcatacagtgcaaaccaatctcccgctgctggatcaaacatcgctgactggtatagagatattccacaggatcttccagcgtcagaatatgcgcatcggcatgttgattgagatagccaaccatcgccgccagcgtggtagatttgccgctccccgtcgcccccgtcaccagaatcaggccattctcgctcttgagtaattccggcaataccggtggtgcgccaagctgttcgagctgcgggcagtgcgaaggtaacagccgtaacgccagagaaataccttgccgttgtgcgaacgcactgccgcgcaatcgctggttttccgccagcgacacagcaaaatccagctgaccattctccagcaatattgcccgctgatcgtcatccagccactcccgcagtagctcttcgacgtccggcgcgtcaaacggcgcagcttccattctcccgcgaatacgccatcgtgcgggccaggcgctgcacaggtgtagatccgagacgttatgctttacactaagggccacaatttcttccatattcatactaagatcctcggaaaatgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgagcgtaacaggattagaatggcattttattggcccgttgcagtctaataaaagccgcctggtggcagagcatttcgactggtgtcataccatcgaccgtttgcgcatcgctacccgtctgaacgaccagcgcccggcagaacttccccctcttaacgtactgattcaaattaacattagtgatgaaaacagtaagtccgggattcaactggctgaactggacgagctggcagctgcggtcgctgaactaccgcgtttacgtctgcgcgggctgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataaggaattaaaggaacgccatgaatacgttgactttcctgctttcaacggtcattgagctgtataccatggtgctgttattacgcatctggatgcagtgggctcattgtgatttttacaaccccttctcacagtttgtagtgaaggtaacgcagccgattatcgggccactgcgccgcgttattccggcaatgggccccattgatagcgcctcgctgctggttgcctatattctcagtttcattaaagccatcgtgctgtttaaagtggtgaccttcctgccaatcatttggattgccggtttattgattctgctgaaaaccatcggcctgctgattttctgggtcctgctggtgatggcgattatgagctgggtaagccagggtcgtagcccgattgaatacgtgctgattcagctggccgatccgctgctgcgcccgattcgccgcttgctaccggcaatgggtgggattgatttctcgccgatgatcctcgttctgctgctgtatgtcatcaatatgggtgtcgcagaagtcttgcaggcgaccggaaatatgctgctgccggggctgtggatggcgttatgagtgccgtaacagttaatgatgacggtctggttttacggctctatattcagccgaaagccagccgtgattctattgtcggtttacatggcgacgaggtaaaagtcgccattaccgcgccgccggttgacggccaggccaacagccatctggtgaagtttctcggtaagcaattccgggttgccaaaagccaggtggtgattgaaaaaggcgaacttggccgccacaaacaaattaaaatcattaatccgcaacaaatcccgccagaaatcgcggcgttaattaattaggtatcctatgcaaaaagttgtcctcgcaaccggcaatgccggtaaagtgcgtgagctggcgtcgctgcttagcgacttcggtcttgatatcgtggcccaaacagacctcggcgtagattccgctgaagaaaccggcctgacctttatcgaaaacgcgattctgaaagcgcgccatgcggcaaaagtgaccggtttaccggcaattgccgacgactccggtctggcggtagatgcgctgggtggcgcgccgggtatttactccgcgcgttattccggtgaagacgcgaccgatcaaaagaatctgcaaaaactgctggaaacaatgaaagacgtaccggacgaccaacgtcaggcgcgtttccactgcgtgctggtatatctgcgtcacgcggaagatcccactccgctggtatgccacggtagctggccaggcgtgattactcgtgaaccagcgggcactggtggctttggttatgatccaatcttcttcgtaccttccgaagggaaaaccgctgccgaactgacccgcgaagaaaagagcgccatttcccaccgtggtcaggcgttgaaactgctgctggacgctttacgtaatggttaaattaccgccgctgagtctctacattcacatcccgtggtgcgtgcagaaatgcccgtactgcgatttcaactctcacgcgttgaaaggagaagtgccgcacgacgattatgttcagcatctgcttaacgatctggacaacgatgtggcttacgctcagggccgtgaagtgcagacaatctttattggcggtggtacgccgagcctgctttccggcccggcgatgcaaacgctgctggacggcgtgcgtgcgcgtttgccgctgacagcggatgcagaaattacgatggaagcgaaccctggtacggttgaagccgatcgctttgtcgattatcagcgtgctggtgtgaaccgcatctctattggtgtgcagagttttagcgaagaaaagctgaaacgacttgggcgcattcatggcccgcaagaagcgaaacgagctgcgaagctggcgagcggtttagggttacgtagctttaaccttgatttgatgcatgggctgccggatcaatcactggaagaggcgctaggcgatctgcgccaggctattgaactgaatccgccgcatctttcctggtatcaactgaccatcgaacctaatacgctgtttggctctcgcccaccggtgctgccggacgacgatgcgttgtgggatatattcgaacaggggcatcagttattaaccgcagcgggttatcagcaatatgaaacttccgcttactccaaacccggttatcagtgccagcacaatctcaactactggcgctttggtgactacattggtattggctgcggcgcgcacggcaaagtgaccttcccggatgggcgcattctgcgtaccaccaaaacgcgtcatccgcgtggttttatgcagggaagatatctggaaagccagcgtgatgtcgaagctgcagataaaccgtttgagttctttatgaatcgcttccgtctgctggaagccgcgccgcgcgtggagtttagccagtatactggcctttctgaagaagttattcgcccacagttagaagaggctatcgctcagggttatctcacagaatgtgcagattactggcagataacggaacatgggaagttgtttttaaattcgttgctggagctttttctggcggagtaaatttgtattgccggatgcggcgtgcgtgtacgcagcatccggcaacaactcatgcgtcatcgcaaaaattacttaatcaccccattgcgccgcagttgttcggtatcttttttccagcgttcattagcctggttgatatcgtcaattttcatcaaaatcgcgacttttttactgtttatttctgaaactttcatcgttaacggatattgccctttctcgagcgttatccagtcatcctgcaatttacggctaagtttttgtgattgcagaaaagtctgtcgccgttgttcgttgatatcaaaatctcgtttctgctgaattggcacttcataacactcttcactctgtttatgacatgccgcaatcgccggttgataaacctctttgtcatatttaaccgcgaacgcctcactatcgttctgtttattaaaatcatcacgctgttggtgaatttttttaaaggcgtcttcgcgggtcatttgcttaccgtttgcatcttttccccaatatgcatccgctgctttctgcgccgccaccatttgcttatcaagcgcttttacatcctttttcagtgcaggaatcgagttattctggttattcaacgcagactcaagctgactaaagcgataattgaaatcttcgctattcacgatcagatatttattattcgttttgatatcgtcaaccacccgcccacgatcgctggctgccgcctgaaaagagtaaaagttcaccgaccagccagacgcgggcgttcctttactggttaacatcgccgagaatttcaccggtttatctttcgtccaggtctgttcgagcagctcgtaatctgccaactgaccgacccaggtatagagatcgtcactggaagagacatcgccttccgctgaccaggtggcctgattacccttagcatcaagattttttaaggtgatgacatcaagcttgagaatgccgtgatactgctttttgaattgatcttttaagatattttcagttggcggttcaccatctgcccagacattaccagtcatcaacataaacagcgccgtaccaacaatccattgctttttcacccgaaaaccctcgcgcggaataatttattccggtgattatcattagggtaataaaaattggcaatggacgtgagtctgaagtgaataagccccggcacgataccggggcgaagtgattagtactgattgaagatctgctggatctgctgcggatctttagtttgcgtcagagccagttgcagcagaacgcgcgctttttgcgggttcaacatgccggaggcgacgaagccgtatttcgcatcatccacttcggcatcttgagtggtagcgcccgtcggtacgcgggaagaacgcactactgcagtgccgtttttcgcagcggttgcaagggtgtcaaatacggttttatacaggttgccgttacccacgccagcgctaacgatgccatcatagcccgcatctaccagtgctttagccggaagatcggatgcgttagcgtagttataaacaatgccgactttcggcagttcattcagcttagagacatcgaacggcgtgtcgctggtgtgcttacgtgccggggtacgttggtagtcaatcttaccgttgtgaatgtaacccagaggaccgtagttaacagacttgaaggtcgctacatcggtggtgttggttttggtgacatcacggccatcaagcacggtgtcgttcatcactaccagtacgccacgattagcggaggctttatcagctgcggtcactaccgcgttatacaggttgaatggaccgtctgcgctcatagacgtggacgggcgcattgcaccgaccatcaccaccggtttgtcgcatttcaccgtcaggtcgaggaagtaagcggtttcttccatcgtgtcggtaccgtgggtaatgacgaagccgtcagttttatcgcagtcggtgttaatttttttcgccagtgtcagccagacatcatcgttcatgtcctgggagccaatattcactacctgctcgcctttaacgttcgcaatgtccttcagttgcggcaccgcattaaccagattttctacgccaactttacccgctgtgtagttagatttggttgcggagtcaccaccaccggcaatggtcccgccggttgctaaaatggtgatattgggtaatgccaatgctgcaccactaaaacccataaccagtgcggcaagtgccgtctttttgaaaaactccatttcattcctccagttacgtgaacgctacgcattatcccttagctttgcatgggaaatttgacgttaaacaatttacaacgtgaatatattttggagatctacaaagttagaggcaggtaacaaaacgaagaattaaacggcataaaaaagtattatgccgtcttaaaatagaggattattttaaattcccgaccagggctttgcggctatcttccagagtcacaacgcggctacaaacatctttgccaaactgctggaaatctttttcctgctttttccactcggtttggattgaggattgcaggccgcccaggcttcccagcacgttctgtaatgggttaccgccgcttttcagcaccgctttcgcgcccatttcattaatgctgtcctgtaaaattccgcccattgcctgattcactaattgctggccttcggcacgaacctgatcaatggctttatagtgaaacgtcaggccatcgctgcgcgtttcgataatgcggttcatctgctctttcagctgcgcatcaagtttggtcagacggctgcgcattttgctgctttcgcccatctcctgaacgataattttatccagcgcaatacgagctttctcgacgcggcttttcgcgccttcatcaatccacggcagggtgctacgtagttcagcctgataatccttcgcctgctcgcgctgggcggcattcagggaatattgcttaccgttatacatcacgttgccgtctggcgtgatcaccagattgccgttttcgcccttcacctgcacggtttgcgggctgacaatcacatcgtcacgcggcgtgacgctgcactggtagtcggcgtgagcggtcattgccgtcactgaaagtgctgccgccagcagcattttgcgcatcatagtcttccctcaagaacaaatcaggccagcatttgctggccccagattgataacaaagtgcgcgttttccatgccggatgcggcgtaaacgccttatccggcctactcgatcgtgcatctttgtaggcctgataagcgtagcacatcaggcagttttgcatttgtcatcgcccgtatgctttcttagtcccaccaaacgtcgaaaagttcgctggtgcgtacctcttccagtttgcgttcttccagccacttacgcacaatcgcctgatgttcttcggtgcatttgccgatttcctgcatgcagatcagaccttcccaggccagataaccgctgccgtcaaaggccagtttgttcggttcgataacctcgttaataaagtcatcaacggttttatcaatctgttcttccgatgtaccttccgggaatcgccatgccaccgaaaatcctaattcctggaattcgtcgatgtgcatttttttacgcagacgacggctacggttctttgccattatttcaccctctcgaacattaagtcccatactccgtgaccaagacgatgaccacgttgttcaaatttcgtcaccggacgtgatgccggacgcggtacgtaatcattgctctctgacaggtttttataaccgtcaatagaagacatcacttcaagcatatgttccgcataaggttcccagtcggtcgccatatggaatatgccccccagctgcagtttgctttttaccagctcggcaaacggcacctgaacgatacggcgtttattatggcgcgctttgtgccacgggtcagggaaaaagagctgcaccatgcgcaatgaattgtcaggaatcattttatgcagcacttcaaccgcatcgtgacacatcacgcgcaggttgcttaagccctcttcatgcgcagaagacaggcacgcaccaacgcccggtgaatgcacttcaatgccgaggaagtcctgctcggggcgatctttagccattgccaccagcgacgcgcccatgccaaaaccaatctcaagcgtcaccggcgcttcacggccaaaaagcgcagggaaatccagcatatcttcgctgaactcaacgcccatcaccggccagtagttttccagcgcatgttcctggcctttggtcagtcgcccctggcggcgcacaaaactacggatacggcgcagcgggcggccgttttcatcaaattccggtgagatgacgtcgtttttcataaagatttagtcgcttgtgaaagtgttctgaaaacgggcattatccaaagttagttgccggatgcaagcatgataaggccgtggctgcggaaagttccggtttacaccctgccgtcgctgtgctgcaatcttgcccccaacaacagtgaattcggtgaccatgcaagcgtcgcaattttcagcccaggttctggactggtacgataaatacgggcggaaaacgctgccctggcaaattgacaagacgccctacaaagtatggctctcagaagtgatgttgcaacaaactcaggttgcgaccgttatcccctattttgaacgctttatggcgcgcttcccaacggtgaccgatctcgccaatgcgccgctcgacgaagttctccacttgtggaccgggcttggctattacgcccgcgcgcgcaatctgcataaagcggcacaacaagtggcgaccttacacggcggtaaattcccggaaacctttgaagaagtcgcggcgttaccgggcgtcgggcgttccaccgcaggcgcgattctctcgctttctctgggtaagcactttccgattctcgacggtaacgtcaaacgggtgctggcgcgctgctatgctgtaagcggctggcctgggaaaaaagaggtcgagaataaactatggagtttgagcgagcaggtgacgcccgcggttggcgtggaacggtttaatcaggcgatgatggatttgggcgcgatgatttgtacgcgctctaagccgaaatgttcgctctgtccgctacaaaacggatgtattgccgccgccaacaatagctggtcgctttatccgggcaaaaaaccgaaacagacgctgccagagcgcaccggctactttttgctgttacagcacgaagatgaagtattgctggcgcagcgtccgtcgagcggattgtggggcggtttatactgtttcccgcagtttgccgatgaagaaagtttgcggcagtggctggcgcaacgacagatttctgccgataacctgacgcagctgaccgcgtttcggcataccttcagccatttccacttagatattgtgcctatgtggcttcccgtgtcgtcattcaccggctgcatggatgaagacaatgcgctctggtataacttagcgcaaccgccgtcagttggcctggcggctcccgtggagcgtttgttacagcagttacgcactggcgcgccggtttagcgcgtgagtcgataaagaggatgatttatgagcagaacgattttttgtactttcctgcaacgtgaagcagaaggtcaggattttcagctgtaccccggcgaactgggaaaacgcatctataacgagatctccaaagaagcctgggcgcagtggcagcacaaacaaaccatgctgattaatgaaaagaaactcaacatgatgaatgccgagcaccgcaagctgctggagcaggagatggtcaacttcctgttcgagggtaaagaggtgcatatcgagggctatacgccggaagataaaaaataaaaacagtgccggagcacgcctccggcaacttgcataaaaacaaacacaacacgcacccggaatgatgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggcttcaaagaggtggtgatcgccggtcctaaggactacgtgaaatacaccgatcaatatcagacccgcagccacatcaacttcgatgacggtacgattactatcgaaaccatcgccgggacagaacctgccgcgcatctgcgccgggcaattatcaaaacgttgctgatgggggacgatccgagttcggtcgatctctattccgacgttgatgatattacgatttcgaaagaacctttcctttacggtcaggtggtggacaacaccgggcagccgattcgctgggaaggtcgcgcgagcaacttcgcggattatctgctgaaaaaccgtctgaagagccgcagcaacgggctgcgtatcatctacagcgtcaccattaacatggtgccgaaccaccttgataaacgtgcgcacaaatatctcggcatggtccgccaggcgtcacggaaatatggcgttgatgagtcgctgattctggcgattatgcagaccgagtcatcctttaacccatatgcggtcagccgttccgatgcgctggggttaatgcaggtggtacaacatactgccgggaaagatgtgttccgctcgcaggggaaatccggcacgccgagccgcagtttcttgtttgatcctgccagcaatattgataccggcaccgcgtatctggcgatgctgaacaacgtttatctcggcggaattgataacccaacatcgcggcgttatgccgtcatcaccgcctataacggcggcgcaggcagcgtgctgcgagtcttttcgaatgataagattcaggctgccaatattattaacaccatgacgccgggcgatgtttatcagacgctgacgacccgccatccctctgcggaatctcgccgttatctttataaagtgaataccgcgcaaaaatcctaccgccgccgataattccactaaccgcccctgacgatgctcaggggcaaaaatgttatccacatcacaatttcgttttgcaaattgggaatgtttgcaattatttgccacaggtaacaaaaaaccagtccgcgaagttgatagaatcgcatcatctcgcacggtcaaatgtgctttttcaaacactcatccgcatcacgatgtgaggaaattaacatgaatcttaagctgcagctgaaaatcctctcttttctgcagttctgtctgtggggaagttggctgacgaccctcggctcctatatgtttgttaccctgaagtttgacggtgcttctattggcgcagtttatagttcactgggtatcgccgcggtctttatgcctgcgctgctggggattgtggccgacaaatggttaagtgcgaaatgggtctatgccatttgccacaccattggcgctatcacgctgttcatggcggcagaggtcactacgccggaggcgatgttccttgtgatattgattaactcgtttgcttatatgccaacgcttgggttaatcaacaccatctcttactatcgcctgcaaaatgccgggatggatatcgttactgacttcccgccaatccgtatctggggcaccatcggctttatcatggcaatgtgggtggtgagcctgtccggcttcgaattaagccacatgcagctgtatattggcgcagcgctttccgccattctggttctgtttaccctgactctgccgcatattccggttgctaaacagcaagcgaatcagagctggacaaccctgctgggcctcgatgcattcgctctgtttaaaaacaagcgtatggcaatcttcttcatcttctcaatgctgctgggcgcggaactgcagattaccaacatgttcggtaataccttcctgcacagcttcgacaaagatccgatgtttgccagcagcttcatcgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgctctgtttgcttacggcgacccgactccgttcggtactgtactgctggtactgtcgatgatcgtttacggttgcgcattcgacttcttcaacatctctggttcggtgtttgtcgaaaaagaagttagtccggcaattcgcgccagcgcgcaggggatgttcctgatgatgaccaacggcttcggctgtatcctcggcggcatcgtgagcggtaaagtggttgagatgtacacccaaaacggcattaccgactggcagaccgtatggctgattttcgcaggttactccgtggttctggccttcgcgttcatggcgatgttcaaatataaacacgttcgtgtcccgacaggtacacagacggttagccactaattacgcaaagaaaaacgggtcgccagaaggtgacccgtttttttattcttacttcaacacataaccgtacaaccgtttcatgccattcgcatcggtttcgctatagacaccttgcaactccggcgaaaatcccggcaacaaattcacgccttcttccagcgcaaggaaataacgttgaaccgccccaccccagacttccccgggtaccacgcaaagcacgccaggtggataaggcaacgccccttctgccgcaattcgcccttcggcatcacgaatccgcaccaactccacttcaccgcgaatataagcgctatgcgcatcctggggattcatcaccactgacgggaaactctgctggcggaacatcgctttttgtaggtctttgacgtcgaaactgacatacagatcgtgcatctcctgacacaactggcgcagggtgtagtcgcgatagcgcaccggatatttgttataaacgctcggcaacacctcagccagcggcgagtcatcctcaatatgctgttcaaactgcgccagcatcgccaccagttgtgccagcttctcgtggctttccgccggagttaataagaacagaatggagttgagatcgcacttctccggcacaatgccgttctcacgcagatagtgcgccagaatcgtcgctggaacgccaaaatcgctatattcgccggtttcggcatcgataccctgcgtggtgagtaacagcttgcacggatcaacaaaatactgatccgcggcatatccttcaaagccgtgccacttcgcccccggatcaaaactgaaaaaacggcggtcgctggctaacactgacgtcggataatcctgccacaatttgccatcaacaacgggcgggataaacgggcggaacagcttacagcgcgcaagaatagccttgcgcgactcaatacccaactcaacgcactcagcccacagccgacgcccactctccccttcatgaattttggcgttaacgtccagcgcggcgaacagcggatagaacgggctggtagaagcatggagcataaaggcattattcaaccgcttatgcgggcaaaaacgcgcctgtccacggatatggttatcttttttatggatctgcgacgtctgtgagaatcccgcctgctgtttgtgcaccgactgggtcacaaagatccccggatcgttttcgttaagttctaacagcagcggcgagctatccgccatcatcgggataaactgttcgtaaccgacccacgcggaatcaaacagaatgtaatcacacagatgcccaacggtatcgatcacctgacgggcgttatagacagtgccgtcataggttcccagctgaataatcgccaggcgaaacgggcgcggcaggtcggctttttctggcgcaacgtcgcgaatttgctggcgcagatactcttcattaaaacagtgcgcatcaataccgccaatgaaaccaaacgggttacgtgaagcttccagatagaccggcgtcgcccccgcctgaatcaacgcgccgtgatgattcgacttatggttgttacggtcgaagagcaccagatcgccacgcgttaacagcgcattcgtcaccactttattcgctgccgatgtgccgttcagcacaaaataggttttatcggcatgaaagactttggctgcaaatttctgcgcatctttcgccgatccttcatgaataagcagatcgcccaattttacgtcagcgttacacatatcggcgcgaaagatgttctcgccaaagaaatcgtaaaaatggcgtccggcaggatgctttttaaagaacgcaccatgttgatgtccagggcaagcaaaggtgctattacccatctcaacgtactgcgtcagcgtgtcataaaacggtggcagcaaattctcttcatactgacaggctgcggattccagctccagccactgctgctcgttgccgttgattaccgccgtaacgcccgcaggtaattcaacagcatgttcggaatacaaaaacaccggtagatgaaaaccggtgcgcttaagcaacgcaagaatgccactgcgactatccgcagcggtaatgacgactgccgcgacgtccgtaaaatcagtatctcccaacgctaccacgcagcgatgagtagaaagtcgggataccagttcactactggcggcaatattcattgatttcataagcgcaaaacccgtttcggggaagtaagaataccggacaaggtggaaaaccctgccccatgagatatgggtcaaactggtcaccagctccgaccgccagacatcagtaaaagcagaaacgctctgattttactgttgtcctgcagtgagcgtgcgttaacttcaccgcatgagcagtagcataaaaagagaagagtttcgcgcgaaacggcgataagcgagagaatgtaaggaggtggcgtgcatcgggcaaactccgtacagagaggagaaaattcgcgcaatcatggcacctttcgctaaagcgtgcaagccaggactttgcgaacaaacaagccatcgacggcgccaaaagttcataataagaaaatcaaacaatacagctaacaggaactcttgtggtcatcggcccttttatcaacgcaagtgcagtcttactgggtggcgttttcggcgcactccttagccaacgcttaccggaacgtatccgcgtctccatgacatcaatttttggtctggcatcgctggggattggtattttactggtggtgaaatgcgccaaccttccggcgatggttttagcaaccttactcggagcattaatcggcgaaatttgtctgctggaaaaaggcgtcaatacagtggtcgccaaagcgcataatctgtttcaccactcgcgtaagaagccagcgcatgaatcttttattcagaattttgtcgcgattattgttctgttttgcgccagcggcaccggaatcttcggggcgatgaacgaagggatgaccggcgatccgagtattttaatcgccaagtcatttcttgatttctttacggcgatgatcttcgcctgctcgctgggtattgcggtgtcggtgattagcattccattactgatcatccagttaacactggcgtgggctgccgcgctgatattaccgctgaccacaccgtcgatgatggcagacttcagcgccgtaggcggtttattgctgctggcaaccggattacgcatctgtggtattaaaatgttcccggtggtcaacatgcttccagcactccttctggcaatgccgctttccgccgcctggaccgcctggtttgcctgacaatgtgtgcaatagcggcaaagtgatgatagattgtgcagtctgcactaaattgaagaaatttgattgacgagacgaggcgaatcaggtttaatgcgccccgttgcccggatagctcagtcggtagagcaggggattgaaaatccccgtgtccttggttcgattccgagtccgggcaccactattctaaagaacccgcccacaaggcgggtttttgcttttggatctttatataaaataaacttgggagcataacgccatcaggtcttaaacactcccgaatcatcaataaacatcccccgttaacaaaacacagttcagttcacataacatccctgtaatcccacacatatctgctggccgaacgacgccagtgcgcgtacggaggcaagagcagccctgcacatggcagcgcttgtggtaacctggtttaatccggtgataaaggcattttacatgcatctgtcagcagccggaaaaaccaaaaaaatggcgctggttgactgtatgcgtaaattgctgaccatcctgaacgcaatgctcagaaagaacgaagagtgaaatgaatcgtagcatcatgttgctccataatttttacgttcaagacagttgattatcggcgcatatgactcaaaaagagcctgatgattgcctcttttccataggctctttatctgaagtgaaggaaggcccggaagaaagcactcgctggcatacgtgactccagctcaaccggagataatcaccactgttatttttctatttaataataatctcctgaaaaacagatatagcaaaaatacaatccggccagatttaattccgcattcattaccagaaataatcaacatcacaactatcatatcattcaatagtcaccgctaaaattttattattttcctcttctttacatagaaattgtcaacctgtttattatgccgctttaaatagttaatcacaaaacaacatcaccattatttacgtgttttatttattaataacatggtcatacgttctttttttacgaggaaataatcaattgataaattgtttttggtcttaatagtcaagtgagaaacattttaataaatgataaaaatcctaaattccttgttcataatgtaggggtgtgttaaataggtgggcaaaatttggttccccttctcgcctgtaatattgcagcatcttcgcacctccatgagacattgcgacttaataagaaggtgataagtcctgcatataagcatggactgaccatggttttatattcattaaaaattttgttacaacccattgatttagcataaataaattatagtgggttcgggtttgttgtgactgtggcattatttccgtgcaaaggagctgatatgtctgaaagacatttacctgatgaccagagcagtactatcgatccatatctaattacctctgttcgccagactctggcagaacaaggcgcagcattacaaaacttgtctaaacaactggattccgggcagtaccagcgtgtccttaatttgataatgaactgtaaagggcacgttattctttcgggaatgggtaaatcagggcatgtcggtcgtaaaatgtcagcgacgctggcctctacgggtacgcctagtttctttattcatcctgcagaagctttccatggcgatctgggcatgattacgccttacgatcttctgatccttatttctgccagcggtgaaacggatgaaatcctcaagctagttccttcactgaaaaatttcggcaaccgaattatcgccattaccaataatggaaattccacgctggcgaaaaatgctgatgccgtgctggaactccatatggcgaatgaaacctgcccgaataatcttgcaccaacaacgtctaccacgctgacgatggcgatcggcgatgcgctggcgattgccatgatccgccaacgcaaatttatgccgaatgattttgcgcgctatcacccgggcggttcattaggtcgtcgcctgctgacccgcgttgctgatgtcatgcaacatgatgttcctgcggtacagctggatgcgtcatttaaaaccgtgattcaacgtatcaccagcggatgccagggaatggtgatggtagaagacgcagaaggtgggctagcgggcattatcaccgacggtgacctgcgtcgctttatggaaaaagaggattctctgacatccgccacggctgcgcagatgatgacacgtgaaccgctgacgctaccggaagacaccatgatcattgaagcggaagaaaaaatgcaaaaacaccgtgtctcaacgttattggtgaccaacaaggcaaataaagtcactggccttgtgcgcattttcgactaattaagcaacggggttcgagaggttagtctctcattgagtttgcgccccactgaaactttgataatcgttacatgttgataaaagtgaagtctgccgtatcctggatgcgtgctcgtctgtctgccatctcactggcagatatccaaaaacacctggcgaaaatcatcattctggcaccgatggcggtgctgctgatctatctggctatcttcagccagcctcgctatatgagcgagtcgaaagtcgccattaaacgctcggatgatttaaacagcggcagcctgaattttggtctgcttctgggtgcctctaaccccagttccgcagaagatgctttgtatctgaaagagtacatcaactcgccggatatgctggcggcgctggataagcaactaaattttcgtgaagcatttagccacagcgggctcgattttcttaatcatcttagcaaggatgaaaccgcagaaggattcctgaagtactacaaggaccgtatcaacgtctcgtatgacgataaaaccggattactgaatattcagacgcagggctttagcccggagtttgcgcttaagtttaaccagaccgtgctgaaagagtcagagcgctttatcaatgagatgtcacatcgcatcgcgcgtgaccagcttgcctttgcagaaacggagatggaaaaggcacgccagcgtctggacgccagcaaagcggaattgctctcttatcaggacaacaacaacgttctggatccacaggcacaggcacaggcggcgagcacgttagtcaatacgctgatgggccagaagatccagatggaagcggatctgcgtaacttgctgacgtatctgcgtgaggacgccccgcaagtagtgagtgcgcgtaatgcgattcagtcattgcaggcacaaatcgatgaagaacaaagcaaaatcactgcgccacagggtgacaagctaaaccgtatggcagtggattttgaagaaatcaaatcaaaagtagagttcaacaccgagctgtacaaactgaccctgacctccattgaaaagacccgtgtagaagcggctcgtaagctcaaggtgctgtcagtgatcagttcgccacagttgccgcaggaatcgtcttttccaaatatcccttatttgatcgcctgctggttactggtgtgctgcctgctgttcggcaccctgaaactgttgctggctgttattgaagatcaccgagactaacgctgtcgctgaatgagtttgtgatgaaattatttaaatcaattttactgattgccgcctgtcacgcggcgcaggccagcgcggccattgatattaacgctgacccaaaccttacaggagccgcgccgcttaccggtattctgaacgggcaacagtcggatacgcaaaacatgagcggcttcgacaatactccgccgccctcaccgccggtggtaatgagccgtatgtttggtgctcaacttttcaacggcaccagcgcggatagcggtgcgacggtaggattcaaccctgactatattctgaatccgggtgatagcattcaggttcgcttgtggggtgcgttcacctttgatggtgcgttacaggttgatcccaaaggtaatattttcctgccgaacgttggtccggtgaaagttgctggcgtcagtaatagtcagctaaatgccctggtcacatccaaagtgaaggaagtataccagtccaacgtcaacgtctacgcctccttattacaggcgcagccagtaaaagtgtacgtgaccggatttgtgcgtaatcctggtctgtatggcggtgtgacgtctgattcgttactcaattatctgatcaaggctggcggcgttgatccagagcgcggaagttacgttgatattgtggtcaagcgcggtaaccgcgtgcgctccaacgtcaacctgtacgacttcctgctgaacggcaaactggggctttcgcagttcgccgatggtgacaccatcatcgtcgggccgcgtcagcatactttcagcgttcagggcgatgtctttaacagctacgactttgagttccgcgaaagcagcattcccgtaacggaagcgttgagctgggcgcgccctaagcctggcgcgactcacattacgattatgcgtaaacaggggctgcaaaaacgcagcgaatactatccgatcagttctgcgccaggccgtatgttgcaaaatggcgataccttaatcgtgagcactgaccgctatgccggcaccattcaggtgcgggttgaaggcgcacactccggtgaacatgccatggtactgccttatggttccactatgcgtgcggttctggaaaaagtccgcccgaacagcatgtcgcagatgaacgcggttcagctttatcgcccatcagtagctcagcgtcagaaagagatgctgaatctctcgctgcaaaaactggaggaagcatcactttctgcccagtcctccaccaaagaagaagccagcctgcgaatgcaggaagcgcaactgatcagccgctttgtggcgaaagcacgcaccgtagttccgaaaggtgaagtgatcctcaacgaatccaatattgattctgttctgcttgaagatggcgacgtcatcaatattccggagaaaacatcgctggttatggttcatggcgaagtgctgttcccgaacgcggtgagctggcagaagggtatgaccaccgaggattacatcgagaaatgtggtggcctgacgcagaaatcgggtaacgccagaattatcgtcattcgtcagaacggtgctgccgtcaacgcagaagatgtggattcactcaaaccgggcgatgagattatggttctgccgaaatatgaatcgaaaaacattgaagttacccgtggtatttccaccatcctctatcagctggcggtgggtgcaaaagtgattctgtctttgtaaggagttgaaatgagcaaagcagttattgtcattccggctcgttatggctcatcgcgcctgccgggtaagccactgctcgatattgttggtaaaccgatgatccagcatgtttacgagcgtgcgttacaggtggcgggcgttgcggaagtttgggtggcaacagacgatcagcgtgttgaaaaggccgtgcaggcatttggcgggaaagccatcatgacgcgcaacgatcatgaatccggcaccgatcggctggtcgaggtgatgcataaagtcgaggcagatatctacattaacctgcagggcgacgaaccaatgattcgcccgcgggatgtagatacgctgttacaaggaatgcgtgatgaccccgcgttgccagtggcaacgctatgccacgcgatttctgccgaagaagcgaccgagccaagcacggtaaaagtggtggtaaatacccaccaggatgcgctttatttcagccgttcgcctattccgtatccgcgaaatgctgaaaaagcgcgctacctgaaacacgtcggtatttacgcttatcgtcgcgatgtgctgcaaaactacagccagttaccagagtccatgccagagcaggcagaatcactggagcagctgcggttgatgagcgcagggatcaacatccgcacatttgaggttgccgcaaccggtccgggcgtcgacaccccagcatgcctggaaaaagtgcgcgccctgatggcacaggaactggctgaaaacgcatgattggcatttactcgcctggcatctggcgtattccgcatctggagaaatttctggcgcaaccgtgccagaaactttctctgctgcgccctgttccgcaagaagttaatgctatcgccgtgtggggacatcgtcccagcgcggcgaaaccagtcgccatcgccaaagcagcgggaaaacccgtcattcgtctggaagatggatttgtgcgttcgctggatcttggcgtcaatggcgagccgccgctttctctggtggtggatgattgtggcatttactacgatgccagcaagccttcggcgctggagaaactggtacaggataaagccggaaatacagctctgataagccaggccagagaagcgatgcacaccatcgtgaccggggatatgtcgaaatataatctggcgcctgcgtttgtggctgatgagtcagaacgtacaaacatcgttctggttgtcgatcagacatttaatgatatgtcagtgacgtatggcaatgctggcccgcatgagtttgctgccatgctggaagccgcgatggcggaaaatcctcaagccgaaatttgggtgaaggtgcacccagatgtactggaaggaaagaaaacaggttatttcgccgatctgcgcgccacgcaacgagtacgtttaattgccgagaatgtcagcccgcagtcgctgttgcgacacgtttcccgggtttacgtcgtgacctcccaatacggctttgaagccttgctggcaggaaaaccagtaacatgtttcggccagccctggtatgcaagctggggcttaaccgacgatcgccatccgcagtccgctttgttatctgcccgacgcggttctgccacgctggaggaactttttgccgctgcatacctgcgttactgtcgctatatcgatccgcaaacgggagaagtaagcgatctatttaccgtgctgcaatggctgcaattacaacgtcgacatctgcaacagcgtaatggttatttatgggcgccaggcttaacgctgtggaagtcggcgatcctgaaacccttcttacgaacgccaacaaaccggctgagtttttcacgtcgctgtactgcggcgagcgcctgcgtggtatggggtgtaaagggggaacagcaatggcgagccgaagcgcagcgaaaatcactgccattatggcgaatggaagatggttttctgcgttcatccggacttggctctgacctgctgccgccgctatcgttggtactggataaacgcgggatctactatgacgccacgcgccccagcgacctggaagtgctgcttaatcatagccagctaacgctggcgcagcagatgcgagctgaaaaattacgccagcgactggttgaaagtaaactgagcaagtacaacctgggagccgatttctctctaccagccaaagccaaagataaaaaagttatcctggtgccgggtcaggtagaggacgatgcctctattaaaacaggcacagtctcgattaagagcaaccttgagttattacgcacagtacgcgagcgtaatccgcacgcctacattgtttataaaccgcacccggatgtactggtggggaatcgcaagggcgatattccggcagaactgactgctgaactcgctgattatcaggcactggacgccgatattattcaatgcattcagcgcgcagatgaagtgcataccatgacgtcgctgtcggggtttgaagcgttattacatggcaagcacgtacattgttacggcctgcccttctatgccggttggggtttaaccgtcgatgaacatcgttgcccgcgtcgcgagcgaaaattaacgttagcggatttgatctatcaggcgctgattgtttatccaacctatatccacccaacacggctacaacctattacggttgaagaggcggcggaatatttgatccagacaccgcgcaagccgatgtttattacccgaaaaaaagcggggcgagtaatacgttattaccgcaaattaattatgttctgtaaggtcagatttggctaaacaatttcatagttgactattacgcaaattatttatgcaaggtaatgcactaaccgttttattatccggtaaaaaatatctgctattgcaggggccgatgggaccttttttcaatgacgtcgccgaatggttagagtcattaggccgtaacgctgtgaatgttgtattcaacggtggggatcgtttttactgccgtcatcgacaatacctggcttactaccaaacgccgaaagagtttcccggatggttacgggatctccatcggcaatatgactttgataccatcctctgctttggtgactgccgcccattgcacaaagaagcaaaacgctgggcaaagtcgaaagggatccgctttctggcatttgaggaaggatatttacgcccgcaatttattaccgttgaagaagacggagtgaacgcatattcatcgctaccgcgcgatccggatttttatcgtaagttaccagatatgcctacgccgcacgttgagaacttaaaaccttcaacgatgaaacgtataggtcatgcgatgtggtattacctgatgggctggcattaccgccatgagttccctcgctaccgccaccataaatcgttttccccctggtatgaagcacgttgctgggttcgtgcatactggcgcaagcaactttacaaggtaacacagcgtaaggtattaccgaggttaatgaacgagttggaccagcgttattatcttgccgttttgcaggtatataacgatagccagattcgtaaccacagcaattataacgatgtgcgtgactatattaatgaagtcatgtactcattttcacgtaaagcgccgaaagaaagttatttggtgatcaaacatcatccgatggatcgtggtcacagactctatcgaccattaattaagcggttaagtaaggaatatggcttaagtgagcgcgtcatttatgtgcacgatctcccgatgccggaactattacgccacgcaaaagcggtggtgacgattaacagtacggcggggatctctgcactgattcataacaaaccactcaaagtgatgggcaatgccctgtacgacatcaagggcttgacgtatcaagggcatttgcaccagttctggcaggccgattttaaaccggatatgaaactgtttaagaagtttcgggggtatttattgatgaagacgcaggttaattgggtttattatggggggaacacaacaaactgccaacataatatatattaaatttcaagtcaatatcttttgaattttaagtagccaaaaaatcatttccatcctcttcaaagaaaagtaacataaaggtaataaaacatactactttaagatttaattttacgactggtactgtaatagaatataaaatgtagcttttattactcccccaagaaaatccttttatcgtgcaaagagggagatgttatatcatccgataatattttaacattatcaaaattctttaaaatatcgaaatggagacgcagcgtattaatccctttttgggatttatcattatcacacaactttatcataagaggcgctattgaataagactgacatcttttagaaactaaaggtgcatataccaaagaagatgatgttaatccaattaagtgttttatttttgctttttttattaccggctctattaaaaagtctggctctgttataagaattatgtcacgacattttgccttttttattgccttttgaattgcattaatattttttttaggctctttagggtgaggttttataaatattcttgcattatcaggcttatctattctaagtaagatagaaattaacgaatccgcaaataatgtatgttcaatcaaatacttttgatttgcatatattatatcatctctagttatagaatatttatggataacattatctattctggttgatgatttaactgatggagcacctttaaactcaacaaatttttgcgcattaaattttttcttaagcaaaattggatatgtaccgtatacattttcaaatttcaaatctggataatggaacaagataattgaattaataatctctgaataaaaattaatatttactactgggttttctttttcggttttataagtccctgtcccctcttcaattaatgaacatcttatattattttttttgaacaaatatacgaagattgcataatgttgcgcatagctcataaaataagcatctttagcttttgaatttaaaactaaataattatatacgttataaaaccatataacctttttaagtgaaaaaacatttgggaaagttggaatgaatagtaccttgtatgaagaaaataatttattatttatttgttcaacaataatttttggcatctcagtatttttttcagttgccaaaacaataagatagttacttctcttgctaaatttttgtacaaatgactcagctttttttaattgccccaggttactaattataaaaatatttttactttttatttttaacggtgatagtagctcttcagccttgtttttagaattaaaaaaccatgagtcacggaaaaacccaattggatttacaaataatttcctcaacttctttaaactagcatcaaatatcatctttcttataccttaataaaactttatggatttttttcaatgtttttattttttttggtcctaatgagaaaaagaaattaaaaaagatcaaaaacaatataatcaatgtagatcttttaattccaaaagtcctaacattaacatttgacggcatttttaaaatatcattcaaaatcttatgttgaatatccctagagtaataaaagttctcctccatccatttttttttaatacgtggaatgtgtttaaaattaaacttattatagtcaacaataagtccagatcttgaaaaataacattgtccattgcaagtatgattaaatccatttattaaataaaccttaattttattagccagacaatatattgcgaccgaagaagatattgtaatacaatattcaactttagaaattaaagaatcaatattatcatcgctaaatgttatatttttcaaatcgaagcgttcaatgtattccttaatatcaaaaacaattgagtctggtgatataagaggatttcgagttttaaaaataaaattcatatgtggatgtttctgaattactctaatcaaaaaacgtgcatattctatcctctttattggcgtcaagggttcattaacttgatcaacgataagacaagaattctcactttttgcattgatattgacatttttaatccatggtggaccaaaaagaattccattaaaaggaacccctattattttacaaatttttttatacgttttaatatcttttggggagttaataagtaaatagtgactattagattttgaaataaaagcttctatctgagaagtaaggacaatgccaggaaaacaagatataattatggtatcttttgttcttacagtattaacaatttcatgaaggtccttccctcctgttgaacaaaaaataaactcaatattaataaaagtgaaaaaacaaacaaagtcatcaggatagaatacaactatcttttcatctaaatttttttttacaaactcttgtagagaattatccaagcagcaaaaaaataaatcatatgaatcaacatctatctgctcaaaaatatttttcaaagctaaaaaatgagaatcataacgaaagacaaaacaaagcactttttttctagtcataactggtggtacattccgggatgtcataaaaatctttgtaatctttattttttgatttaataaaatccttaataattctaacagcattaattaaagcattttctttaaaataaggattactagatgactgtacaacactaataaatttttcatcttgagatatatttatccctctgacgattgcatttttttcaacgggtacatctattacactggctccacgaacacggcctttctgcctatcaccaatgttaattgttgcaacttttaaagatggaacctcaattaaaccagaggaggagttcccaattagcccacaagagtatttaatcattgccaaataatcttctgaacgaatagaaatcaaatatctgaacttatactctttgcaaaaatattttacttttctctgaattatatcagaaccagtgtcagcgttactgccaataaaaataaagtcgtgagtatttttaaaaaaagaaatcgctgacaataactcatctatttgatcattaaccgactgcgtggaaagtgtttcaggatggaatactacaacaaagtaccgttttaacagtgaaccatattttagttccaactcctgcttatttggtaaatgcaatgaaagagcattttctgcaccaagagaaccaatattaaacacactaccaggcttttcacctagttgaattactcgttttttatactcttctgtagaagtaagatggagtttactcattttagtaattgaatgcctaataaactcatcataattagctaatgtcttttcaccaccatgaatatgaattaatggaatattatgcattgatgctgcgatagcgactgaaaatatttcatatctatcgcctaaaaccataaccgcatcatatgtgttatttgaaaaaaaatcaccaaacgaattgaggcaaacactcattgaatggagaatgtgagtatgtgaagttgtattgatatttatatccacaaccttgataatattaaaattatcttgttctataatatgtattgtatttccatacgcattatcacaatgcattcctgtaactgccaaatcaagctgtatttctggagtttctcttagcattgtcaaaagtctccgaactattccatattcagctctagatccagttacgtataatatttttttcatttaacaatctccgctatttcgttttctaatactgtatacccattactattaaaatgtaagccatcataagtatacattttatttagattgccataagagtcttttaaaacgtgatccaagctaataaacttcgcaaaatctacattctctcgaagataagaatttaaatcattaattattctattatctcgatcaatacgcccaaaaacaggaggaaccgacaataaataaatttttgatgcagcatttttcttctttatatactggcatgttttcttcaaataccacaatgtgtcttcttttttccaatcactaacaactatatcattagttccaaaaaagatgaaaacaaactctccgaaattaacaatcagctctttctcaataatatattcatagtactccttcgagtttataccagcgatacctaagttattaacttctatatcatttattttttttacgtcccaataatcaaacagcgagtgtccaattaaagttatatcacttacactatcaaattcatttcgtttctcattgattctattatgtatgttttgataaagtattttttgtctattttttttttgctgaatggtaattgcaagttcgaaatccattctatcatctatatctaaagagctttccttatccataatataagctagtgaatagcgaccaaaaaaatgctttgtatgaagataatgctgcttattagctataaatatagctccattcggatgatattctactattgagtttcgattatatttactataatcaaggtcaaaaaaagacagtgtcgagtaatcatctaatggtctaattatttgtgatggcttattgcttctagtaacagaaacaacacattggtatttttctaaagtttgatataactttacagcctcaataatatgggtcgaatctctaaagggtgaagttggttgtaataaagcaaagctctcataatcagtatatatacttaacgcatgttttataaattcaaatgatgatgctttatcagttgctagttcttccggtctcagcaaaaaatcagcaccatatgactctgctattgctccatactgttcggagtcagttgtcacaattactttctcaaacatttctgactgcaaggcagcttcaattgtataagcaagaagaggtttatctatcagcatcaaagcatttttatttctcaaccctttagatccactacgggctggaattatcgcaataatttttgttctcattattccccctgatttttgaattcgctatgaattattaattcatctggaataaagtcttgctctgcaattttacccaataaattataccactccatcggactgataccattaccaggtctttttgttgttatatttttttctgaaaaaacctcacctttttttatctctgttttagctataatagactttcttgctacgattttattcttcctttctgaagctgtaaccactttactatttgaacctaaagatttttcaacacacctgaccccaatacaaagatgtttcagttcatcaggttctattgaggccaaatgatctgggccagacatagatttatctaaagtgaaatgtttttcaataaaagttattccataaggcaccgccgcaatagctgcataaaacccgctagaatgatcagagaagcctatgttattcttagggaagtgttttttcaaatcattaatagcattaaggtttacatcctcaaagggcgttggatattcagtattgcaatgtaatattgtaatattaccaaccggaactttattatttataaaaatagaaacagactgttttatctcatcaatagtagccattcctgttgatatgattattttcttatcagggatcggaagcttggctattttttcaagatacggtaaattcaataactcacctgaagggattttccatattttttgtttcaaagatgctaaaaaatcaatagagtcttcgtcaaaaggggtagaaaaaacatctaaatttaaactgactgcatattccattagatggagataatcgtcatacttcatttcaagcttttttgtcatttctaactgagattctaattctcctgtgttttttatttgatactctgccttaggtgcaatagctgaaattaatttatcagctttaaatgtttggaattttactgcattaacaccggcctctttggcttttaatatcatttctcttgcaatatcaacactaccattatggttgcaaccaatttcagcaacgatatatatattactcattcattccccctaattaatcttgttggagtcccagcaactacaacattacttggtatatttctaattacaaccgacccagaaccaataatactctttgagcctagcttcaactggccatttacaacagtacagctaccaacaaaagtttcttctccaacagaaacatcaccattaagtacaacattagtagagatattgctacagcagcctatttcattaccatgttcaattaaactcctagtatttattacaacggcatcatgtattctagtatcacggttaagtatacacattttaccaataaaaattccatcacccagtataatatttggtgatagaatagcagttttatctataatgttaattaagcgtagattatgttttcttatgatgtttaaatagtgcttcctagttgatggtttgcctatcccaataaaataataataattatccttattctcgatgtctgcaatatcattacctaatattggatatgattgatgataaccacttttatatttatcgataaatcctattaactcgtaatgtttatgatttaagctgtcaattatagattttgaaaaaccacccgcaccaaatattattaactttttactcatgatatgtctcagttaaatatttccaaggcataatattggaatgtaaccactataggtcttttttgtaatcagcaatggcttccgtaacatttttataaaatttaccttgcccctctttgttaagataaatagcaacatcacaatactcctttaaagctcgttcactatgtgacaccattattaaatgagatttttctcttattttatcgaatatatctgaacatttctttttaaactttgcgtctccaacagcagtgatttcatcaataagataatagtcgaatttaaaagccatacttaatccaaaagctaaccttgacctcatgccagaagaataagttttaatgggcatatcgaaatattttccgagttcggaaaactcttcaacaaaatcaaccctctcatttaactcatcgcgttttgcatatagtcgggcaacaaatttaacattttcacgaccggttaaacttccttgaaatccaccagccaatccaacgggccatgaaattttatgttctgtaataatgttcccactatcaggacgatctataccaccaattatccgaagtaaagttgatttaccggctccattttgaccaatcagggcaatgttatagcctttaggaaaaataatattcaaatttttaaaaacataatgccgcccagtgggcgtgcgataagacttcgtcaaattctcaatcttaatcatgatgtcagcattgcctcttcacgcgttcggtataatgccaggccgatgaacagggtgaccagagtaaacattgcaaggtagttcagactcacgccttcactgatatagccaggcataactgcctcgcggcttaactccacaacatgcactaatgggttccagagtagatatgaccagtattgttttggaatcgagtgtagagggaacatgatgcaggagatgaaatacagcggcttaagcagtatcggcaggaccttttgcatttcaggaaaggttttaccaacgaccataaatattaagccgacgccacatgaaagaatgattaacaaactccaggtgagcacaagttgtaaaaagtttgtaatttcgaaatattcgcctgtcatccagacgataagcatgagcaaaatataaacagcaacgtaaatcagtgtctcaagcagtgcacgtgcaatgatcgtatcgatgggttttactggtcgataattaaacagtccctggttcgcttcaatagcaccaatagaacgtttgctaatactactaaagataaaaaagggaatcaggccattaagtaaaaacaccgggaacgagatgtctggcatagtgcggtgcataacgtaacccaaaattcccaacagtatcagcaaatgcgcggagggttcaagaatcgcccacaaataccccagacgaaacttaccaaagcgtgttcgtatttctcgtagaaataatgcctctacggtgactttctgaacttcaaatccacttcttgccatttgatgatgtgatcctaatctcttcaggtacgctaccgcccttggcttaacagctaccaatacactggaggtaatacttgtttgtaactggataaaatttactcagacggtttgacctttttaatagccgcaaaaaaatttcagcagaaattatttccgcagggataaatagatctatttccgtctcgtttcttctaatccattcttcaggcatgaatgtattcggtcttctggtaatttcagaaaactggccgttttagaatgcagagttaatttctcaggaaattattttttgttattactgttaactacttgattataatatcccctatggattttatgcgtaacaacacttgcaatctgtttcaaaccagaacgcacgcgattgattaccaataaattgttcaccgagaaactatttccctatttaaaattcactcgtgtacttcttatttatatctacagccccctctttacagccatatttgtgatttatatcacatttaaatggtgttatttaagttgcatcaataatcccgaaggtaattattttcgtcgattaaaatatacatcttgattattttgtgtatttattttaaccagtgttacaaccaacaccatccctcagtagatatacctgagcagacatttcttaaaatcgacgaatagtttccctggaaattattatgcttatttgaaattccctttctgattatctcctgtaattttactaatttccaggctacacaaaatacagatcacataagaattatcctatatgttttgacctatcaattgttactcaatgatttattacaactattaataatcataatgtatcaaaacacttaagcatctttacagtcttagaaagatgtcgattaacgaaggctacatggtgaaaaacaggttccttcagtgttaccgaatattccgtggtggtctggagggagataattcttgctacatcgaaactcagcccggtgagcgggtttgacagttccgcactcaccattgggctaagggttatcaggtggggttaaggaaatggcaatacctacccccgtccaaactccagccgctgcacattcaccatcccaggcttctcagcagcactgacatcaatttgtgtcacccgcagcgcatatttttcatccagtgcgtttaaccatttcagaaggtcattaaacaccacaggttctatccagacctgaatattctccccacgctcggctatccgcttgatggccaccgagtgcgcggaagcactgtcactgatgacccgcgatacctgcgcaggcgttgttgtggcagattttcgcgctgcaataatatccggcgcggcgttcttcagtcgggtgttcattgccaccagctgttgcaacatcgtctcctgttgttctatccgttcgctcaacggctgccagatgaggacgtaatatccgacgctaaacaggaacaccaccgctgccagtaacatgcccttttcgcgcggagaacgccccgccaagtgttgtgtcagccagtgttcgccacggcttaactggcgttcacgccattgctgaaaatagtgaataaatttatcgcgtaacatgttatttcctccgcaacgttacgccgccggaaaccgcatcaccctctttctgtaacgcgtcctgttgcacaacataatctgccgccagtgcgctacgcagtttgtcgaaactggcaaagttcgcggcccgcaactgaaggtggagcgtctggcgtttttgatcaaaggtgaaaccacgcatttcgatgtcggaaagtgatgctgatttcagggtgctggctatcgctgacaactcggcgagcagccgggtatcatcggcctgcgggcgatattttttcagcgccatcgtcacctgggaacgcaaattcacaatccgcttctgctccgggaacagtgttaagaactttttttccgcctgggtgcggctttgcgccacctgttcgctgacgctccataacgtcacgccccgttccactaccagcgcaaccagaatcagcaatatcggcagaatcatcacccgccagcgcgcccactgttttcggtagctgacacgaggctgccacggccctgttagcaggttcccttccgattcgccataagtggtaatggcgggcagagccgtaacggtcaggcgttcggcgtccgcaccagcccatgcagacagttcttccggtgcaatgccgaccacagttagtgaaatcggtaaattctgctcattgagctgtgcgcggaacatgaccggagccagcgcccgcccggcgctccatccccggcattcatcgatgcggcagataacccgttgcgcatcgccagccataaacccacaaggaatggacatccagtccggcgcgacggtagcgcgggtgatgccgtttgcctgcaaccactgcgcaatgttgcgcatatgctgctggtgaatcacagctacggttgccagttgctggtcgattttcaacggggcgaaatgcagttcatcgatatcctggttcagctcttcttccagcaaggcgggcagaatcgtcggtatctgcttgcggggcacatcaggcagttcaacctgccagacgctgatccattcgccgggaatgtagagtcgaatcgcatcagtttgcagccattgctggagacgttcgtcagcaacgtcaggccagataccgtgctccacgtcgggtgtatggcgctgccaacggatgggatcagcggcgcaaagcgggaaaaaaatctcaagcatggaactcactcactttctcctgtctgatgccagagaacagaaaagtgttgtgggcccatgcggacaattaacgaattcatcgtcagttcaatctcattcacggtgatatctgaacgcagccagaagtaattgctgtccacgctcaggatggtttttagctgttttttagtacgctcatcgacgtctgcaagtagcggctgagcaagaaactgatcgacatcttcccagcccttcgccggacgttgttgtaataatgcccgcgcctgaacagggcttaaccacgggtcaaacagcgcctcaagaatcacactttgcgtgacatctaatgtattgatgttgatttgctggcgggccatcggcagcgcacagaccaacggtttcagtttttgataaagcccggcgtccattccctgcaccacgcgcatctcgctgatatcagccagcggttgattagcggcgtagaacggcaccgagcgggcgagatactcgctgtcttcacgacccagacgcgtctgcacgctgcggtcttcgtcaataaactcccacaggctttcggctatcagttcggcccgataagcaggcacatcgaggcgcgagatcagggcaatcagttgttgtaccgcgagcggacgcgacgccgtcgtcggctgagcgagggcattcaggttaaagcaggcctgtgcgtcacgcagagtgacggcaatttgcccctgcggcagtgggaaaaaacgcgggccagaagcccacggttgtgccagatgcacacgcttttcatttttcaggctcagactgagcgcgctcagcgccaggctttctgcactggcgctgtaccacagcgcctgctggtactcctgctggctgcgcgttcgcccaagttgttgctgcatccgcccggaaagcgtgatggtcaccagcatcataaccgccagcaataccagcaccacgaccagtgccattccgcgttttggtggtgaggtgatcatgataattgcggcccgcgtaacaaccagatgcgttcaatttcgccccattgtggcgaatgcagggttatgcgtactgccacaggaatcgcctgcactgatgaccagctctcctgccagcgcgtgccgtcgtagaactgcaaacggagcgaatccgccgggattaatttttgcgttgttggcttcacgctgcctgccgcatcggtcagtggccaggctaaccgttcgagataaccgtcatgaatgcggtaaccgacggtgagcagattgctgcgtggcagacgcatcaacgggttaaccacaccgccgcgcacaaaacgcattcctccactctcagacaccagaacgccagcgcccgccagtaacgctggttcacgctggccctgatcgcctcttaccggacgcggcatcatttgtgtcagatcgtgggtcagaaaactcatcgtttgctgcatgaggtttagtttttgatcgtgtccggcgacggcgctattcacgcgtgtaacgccgtttgtcacctgctgcgccatcagtgccagtgaggcaaaaatggctatcgccaccagcatttccagtaacgtgaaaccagcgcgagcccttctcactgttggcctcccacggcgctaaaccaggcgcgtcttgactgaatcactggcgaaaagtcgtcatgaagactgacttcaatatccaccgcctggagcagcacgttaccggtattcagagggatcgttcgccagtaccagcggcttcctgccatatcactctcgccctggtgcctgaccgctcgttgttcacgggtcatcaggtaaagcagcgcagtctggttttcagctacccagcccgctaccgttttctcctcaaggatttgctgattactcagcgtaccgctggcaatctgtaacaccgccatggcagccagcgcaaaaatcgccagcgcgagcatcacttccagcaaggtaaatccgcgcttcatggcatcctctcatcacattgattgagggataacgcgccatcgtgcgccagctttaccgcccaacatgcgttttgcgccgccgagtagaagcgcagcgtaaacggcgtggcgggttcaaaaggcgaaaaacggatctgcggcgtcttctttttcgcctctttttgcagctccagttcaatatcgtgcagcgtcaggcgacgacgctgcagctccagcgcatattccttctgccagatatcactgccgggttgtaacagcatctgcacctgtttcggcaccgtaacctgtgccgataaccgggtcgcagaaacgggcaaccattgcccgtgacgacgctgcataaactggtaacctggcgggtcgattagcacaccgagtgtttgcccttcgatcactgccctgtccttaaactgcgcaaagcgagtcagaaaatcctgcgccgcttttttcgcaggcggctctgaagcggtcgcaaacgtctgtaccacgcccgcactggcaaggccgataaggaaaatcaccagcatgatttccagaagtgtgaatccgcgttcaggcactgattactgaaactcctgcaaattccagttaccgatatctgcgccagcgccctccccgttttcctgaccatctgctcccagggtataaacatcaaacagccctttttcacccgggctgagatactgataatcattgccccacggatcttttggcagtcgtttgatgtatccaccggtacggtagttgcgggcgtccgccatattggctggctgctggatcagcgcctccagtccctgttcggtggtcggataacgcccgttatccagtcggtacatatccagtgcgttttccagcgccacgatatcgctgatggctttttgccgatcggctttctctttgttgcccagcaggttaggcactaccagacttgccaggacgccaagaataacaatcaccaccatcacttccagcagggtaaaacctgcccgtggtttttgtgtgcgggataacgaattcatgtgataactccgtaaattacattccaaccatattgttcagttgcagcatcggttcgaggatggcgatgacgataaacagcaccacacccgccatcatcaccaccagcgccggctcaaacagccctaacgccagccccacctgtgtatcaaattcccgttcctggttgaccgcggcctgttcaagcatggtttccagctcgccgctctgttcgccggaggcgatcatgtacagcatcatcggtggaaacaggcgcagatccgccagcgcggcgcgcaggctgcttccttcgcggacgcgatctgccgccagcagcagttgttgctcgacataacgatttgccgacacggcggcggcggtctgaatgccttccaacagcggaacactgctggcggtgaggatgcttaacgtgcgggaaaaacgcgccgtattcagtccgcgcgcaacacgccccgtcacgggcaggcgcagcaaggttttatcccagcgcaggcgcatcgcaggatttttgagtaaccgttgccccagcaccagaagccccagcaaacccgccagccagtacacgccgctggcctgtaacgcgtcgctcatagcgatgagcattcgggtggaggcgggtagcgcgtgtccgagatgatcaaactgttcgataattttcggcaccactgccgtcagcaaaatagtgactacgcccgttgccaccaccagcagaaccagcggatagagcatggcctgcagcaggcgtgatttcagacgctgccgctgttcggtgtaatccgccaggcgattgagcaccacgtcgagatgtccggatttttctccggcagcgaccatcgaacaaaacagggagtcaaagacgcggggatgttcgcgcaggctgtccgacagggtataaccttcctgaatccggctgcgcagcgccattccgaggctttttacatgcagtttttcgctttgctcactgaccgcctgtaagcaggtttccagcggcattgctgcctgcaccagcgttgccagttgacgagtgaacagcgccagatctgccgtcgccacgcgacgatgtgcgtgccgccgacgctgcaacaatccccctgccgatgcattcatccgggcttcaatgtgcacgggaatgaggtctttaccgcgtaacaattgacgggcatgacgcgcggaatccgcctcaatcatgcctttggttttgcgaccattacgctccagcgcctgatagtaaaacagtgccattacgcctccatggttacccgcagaacttcatcgagagaggtttctccggcgagcactttctcaatgccgttactgcggatacccgcagagtgttgccggacataacgttccagctccagttccccggcctgacggtggatcaaatcacgcaatgtggcgtccaccacaatcagttcatggatggcagtacgtccgcgaaaacctttgtgattacaggcggggcagccctgcggatggtacagcgtgacggcatgcgtatcggagatccccataagacgtttttcttcgtcggtggcaggcgcggcctgacggcagtcggagcacagcgtgcggaccagtcgctgcgccatcacgcccgtcagactggaagagagcaggaaaggctccacgcccatatcctgcaaacgtgtgatcgcccccaccgctgtgttggtatgcagcgtggaaagtaccaggtgtccggtcagtgaagcctgaacagcgatttctgcggtttcggtatcgcggatttcaccgaccatcaccacatccgggtcctgacgcaaaattgcgcgcaggccacgggcgaatgtcatgccgacgcgggtgttaacctgcgtctgaccgatcccttcaatcatgtattcgatagggtcttcaaccgtgagaatgttacgcgagtggttgttcagctcctgcaatccagcgtacagcgtggtgcttttgccggaaccggtcggccccgtcaccagaaaaatgccgtgcggtttgtgtaacagctggcgcaactgcgcagtcagttcgagacttaaacccagacgctccagcgtcaggcgagcctggtttttgtccagcagtcgcagcaccacccgttctccccaggcggaaggcatggtagatacacggacgtcaatcgcccgaccgcccagcagcaacgcaatacggccatcctgcggtacgcgcttttcggcaatatccagtcgcgccatcaccttgatacgcgagaccagcagcgaggccagtttacgaccggggcgcaacatttcatgtaatgtgccgtcaacacgaaaacggatcaccagactcttttcaaacgtctcaatgtggatatccgaagcgccttctttgattgcctctgccagcatggcgttgatcagtttgatgatcggcgcatcgtcgtcactttccagcagatcttccgtttccggcagttcttcagcgagggtaaaaaagtcctcggcggaaccgagatcttccatcagctggcgagcttcggaagagtcccgctgccagaccgcattcagccgctgttcaaattcggcctcgtcgatttgccgcagcgtaaagggcgcgttcagcccccgttgtagctcctgcaaaacagagagcgacaacggatgaacatggaggatctccagcgacgcttcgcaccatgccaccaggctaaaccgacggctgaaactgtagggcagacgcacggtgttagcggtggtttcctgtgctacaggcaccattaacgcgttctcccggcattgaggaacgcgcgtacttccggcggtaaggcctgattttgcgctggcaatatcggctgcgcggtgtgcggcatcaggcttaagccttgctcatcgcggtagatttgctcagcgcgcatgtagttatatttgcgctgcgacacgccgtctgccgccataccgtcacgcaaaatggtcgggcggataaacaccatcaggttacgtttttcttttttatccgccgtcgatttaaacaggttaccaatcactgggatatcgcccagcagcggcactttcgccacgctttctcccgcctggtcgtccatcagaccgccaagcacgatcagctcaccatcgttagccagcacggtggttttcagtttgcgctcgccaaacacgacatcgagactggtctgcccttccactttcgagacttcctgctcaatcaccatctgtaccgcgttaccttcgttaatctgcggcgtgactttcagcatgatgccgacttttttcctctctaccgtattgaaaggattgctgttattggaaccaacggtagagccggttaataccggaacgtcctggcccaccatgaagaaggcttcctggttgtccagcgtggtgatactcggcgtggagagcacgttcgagctggagtcgtttttgaccgcctgtaccagcgccatccagtcgcctttcaccacgccaaccgccgtaccgctaaagccagaaagaagctgagcgagcgtggagagatcgccgttagtatccggatttatggtggtagcaccgttttcgctgatcaccgtggaacctttctgcggcttggctgcagaaatcgctgcccccagcgtaccaatagggatttgcgtaccgttggcaaactgcattaatccggcatcttttgacccccactgcacgccgaagttgatattgctgccttcggcaacttccacgattaacgcctcgacatgcacctgagcacggcgaatatccagttgttcaatcacgctttgcagcgactgcataatgtcctgcggcgcagtaacaatcagggcattactgtgtttgctggcggcgatggagacaacctcacgcccgctaccaactgtgccttccgcctcttctttagccgccgtgagcgtaccgctgacctgcttcagcacatcgaccagatcttcggctttgctgtatttgagatagaacacctggctgttgccgctgcgctccatttctgaatccagccgacggatcagacggcgcattttgtctcgcgtggcggggtcaccactgacaatcacgctgttggtgcgttcatcggcgacaatttgagatttcagcgttgctggctggttctcgccgctgtttttggtcaggctttccagcacgcgggcaatttccgaggctgaggcgttatccagcgggatcacctcttcggtgcgattacccgcgtgatccacgcgctggatcacttccgtcaggcgctccacaacggaggcgcgtccggtaagcataatcacgttggagggatcgtaattaacaacgttgcctgagcctgcgctgtcaatcatctggcgcagaatcggtgccagctcgcgtaccgacacattgcgtaccggcacgactttggtgaccatttcatcgcccgcgtagttgtcactgccttcaccgaccagcggcagcggctcgactttcgcggcgcttgatttcaccaccttcagcacgtcgttttccatcggtacgaccgcatacccctgtgcttccagcaggttaaggaataactggtaatactggcgttcattgagcggagtcatagtgcgaatactcactttcccctgaacgcccggccccataatgatggttttattaaggttagcgccgacggtttcgatgaacgatttcaggtcggtatctttaaaattagcggtgaaagtggcttcttccgcccagaccggtgaactacacaatgccgctgccagcatcagcggcagtaaacgcttttttgttttgaggccagttgtcttcttacgccagatagacaacgtcatatcacgccaaaacacgatgaatgattctcctggattaaatgcggttagcgcagtgcgatggaaatgtcgtagcgcgcacccttgcgtaaaaccgtaagttgaatggaatccattgaaggtaactgccgcatcagagcaatcattgctcgtggatcagtgaaatcctgctgatttagcgcaatggcgatatcgccttccctgaaaccgctggcatcgaacagagaacgatctgcccccggcttcactgcataaccgacaattccctccttacgcacaggcgtaagctggatatagttaaaaattttctgcggatctttcgccagtgcctgacgcacggcagccgggatctccactggcgcactgacgacaggttcagcaacagcttgctttgcttcgtcgctggcggcttttttgctggtcaccgccacaggggggcgttcctcctctgccagactcagacgttccattttcccctgatagcgcagcatcacatggtcgcggttgatttcctcaatcactgcgttgtgagagccaagccgttcaccctgcaaatagacctgctgtttgccgccttcttcaatcaccacgccgggtctggcaccaaaggcgatcccacgcagcaccacattaagacgcgtttctgccacaggcgcagattcaggttgttttaccggtgcggcgacgggttgatatttgccaaaccagttttgttggctgactaattgcacgtcatttttatcgaacggttttgcatccgcacggagcggtttattcaccgatgaggaaaccgccgtatattccgcagaaaaggagaaatagcgccagagtgaatacgccatttttgcagaaataataagcagcatgagccagaacatcccgcgcaccatttttcgcagatgctctttgtctgtattaagagattgtatctggctaagaatgtgacgaattttagtcagccattgaatgagataaattcgtgcgtcacgaaaaacaacccgcgccaatttatatctacccgacgttatgctttgactattccacaggtggtacgatccagtttccgctgatactggttacctgtacgtgtatcattaatcgttatgctgtaattaattccctcggtgatcattaatttcaccgttgggtcagcgcacatttgtcgttgatagctggttaaaaaggcgtcaggtgtctgcgtggtctgagtacccgattcgctgataatggtcatttttaccgtcgtgccactactttgcgccagcactaaggtatatcccgcagatttaatcggcaggttttggctgatattttgcgcctgttttttcgccagtaaactggcgttttcattatggctggcgcagccacttaataatcctgtaacgctcaacaatagcgatattaataccctccctggcatctgttttatcgacatggtaaataatctctaaggttattaataagagttaaaatgtcactttgataatgacgtggttatcattaaaacaatgcctgtagataaagtgttgctataccgcccagacttaaacacggtccaaaaggcagtgtggttgatcctctttttgtaataacggcatatatcagaccgcagcatgatgcgattaaagccacattgggtaacgacaacggccccacccatccacctaacgcagcgaagagtaatacatcgcccatgcctaatgcttctttacgcagaactattccggctatccagcgcagggagtaaaaagtgataaaccccaccagaacgccggtgactgcgtcttgtagcgttaacggactctgctgcgcccatgccgcaatcagtcctgtccacaatacgccctgagtaaaaacatcgggcagccattggttgtcgaggtcgatgatgctcgcggcaatcagccacgcggataatatcatcaccgccagcccccatccactttctggccacaccagactcgccagcaaaaaagcgagtgctgtcaataactcaaccagcggataacgcttgctgattttcgcctgacagtcgcggcagcgccctttgagcatcagccaggagagcagcggaatattgtcacgaacgcggatagtctgctggcaatgcggacagtgcgaacgcggtagcgcaaggcttatttttgactgcgtactcggcgtttcaccatgaaactccgccatttgttggcgcagcatgatggggtaacgccaaatcaccacattcaaaaaactgccgatgatcaatcctccgacggttgccagtatgggcatcgccgcggggtattgctgaaaaacatcaaaaagcatggttaaaggttgtttgttgtaacttgccggatgcgggcctgcgggtgtatgccatatggctttcctccaggcccgataagctggcgcatcgggcatatgtgttgacccgatgcgccttatatcatgccggatgcggcgtgaacgccttatccggcctacaggcttactcggcagacatcttatgctcggtaaccttgttaatggtttccggccctttttccggtttcggcagcttgagtgacgccagcgtgctgtaagccgaagagctcacaccgccctggaaactcatctccgttgctcccggcaactggtaagcacttgcacccggattccatttcttaaagaattccgaaagatccgcctgagcgacccaggatgcacacagcatcagcgtgtcggcagcgttaccattggattcagcacagtaattcttgccaccaaaggtgctgttaccaacatcatcgccgcgcgctttacggtgcatcaactggaacaggttccagcccttcatccctttacgatcgctgtagaacttaggcagctcaccatctggataccactgtttgatatcaaagttttcctctgcccactccttcaactgtgcgtacatcagcagacggtcacccgcaccgccgcgcgcccaggcctgaccgttgctctcgtccagatattccggcgcgacggtaatgtcgtcagcgacacggttcatcttaccgagatagcgatcctgcatgtacagcgccagcacgttgttcgccacttcagttgcacccggtacgttcagcggtgtttctgcagcgttatgaccgacttcgtgccaaatcagccagtcgttcagcggcgtcgtcggcagcgtggtgctgttcgtcgagaagctgctgttcattaccggataacccgagtgcgcatcaccgatggagatctgcacatcgttggtgaaacgatgcttgtgccccgtcaagtttttataggtaaacatccggtgcttaccgtcttcatcattacgaccgtagaagtcattcatcgagctggcaaaggtatccagatctttagcgaattctgctacaccaccagtgaaattgctggcctcaaggttcttcttcggcgtggtatagacgaacgacgcagactccagctcgcccagcggcgccggtgagtccagatcgtttttccattcgccgtctttatagaacggcgcttttactacaccggtaaaggtgaagttagcagaaacatcatccttactgtcgcccttgatataaatcagaccaccataaggcaccttgaaggtcacttcaccgttagcctccagagtatacgttttagtcactcttggcggacggttcagcgcaacttcatgcttctcacgtccagtcaggtcgtcagccagcgccacggtaacagtcactgggactgacgccgaagacttaatggtgacgtcctgctgggccggtgcccacaggccggttgactgcatgttacccgcaaaccatttggtcggattcgagtacaggctgatgttttccgtaacgctctcaccctttgccgatacggatcctgggtacttctccacatcaaccttaatgttcagatcccaccaggaacggcccagcatcagacgcgtcagcggtttttccatatagttgagcggatagcttgggttcatcatgcccgctttgctgctaccgtcaccgtagatcatgttgttatcgaccagcgattttttcagatctgcggagcacttggtgccgcctgcataggcatcattggcgtagcagttcaggaactcggtgaacgttttaaagcccagctcatcttccttgccctcttcgtaacgatatttcgtatcgttccacagccagaccgacatgttctggtacagacgttccagatcaacactgttcagacgctcacctttactgcctttggtacggaaataaagctcatgctgatacaggcgctgaatgttggtgcctaaatccgccgcctgcaccatcgctttcgcggtgtcggcgtcaagattcagttgcgtatagcgcggaacatacatgccacctgttaccggaacatccgtgcctgggcggcgctccaaacagttaatctcgtaatggtaagtcgagtccttacactcctgtaacccaggaaacttctcaaagatttttgcctttgccgcttccagagattcttctgttgtgtattccgcttcatcaataaaggcataacgcgttacctgtttgccctcaacttcctcctgccagctcgcaacttccagtttcggcttgtcatcaggcttgttgtcttgctggtatttccaggtcacttcccctgtatttgggtcgatggtgtacggcggttgcgcgccgtctgcagcaggataacgttcataaacccaaatgccagtcgcgcgacgctgacgaacgcgatccggatacccttgcggatcgttgttcaccaccgatttgttcagagccattgacagacccgcggcatccagcagacgcacaaaactggacgcgctctcttccttaagattgctcatcacgttttccatgatcagcaccgagccacctttgttcagataagcgatcagatcggtcacatcctgctgagtcagcttcggtttgctggtatctgcacgcagaggcacagcatagggatcgccagaccactgagtcacatattcaaagccgttgaggatcagcaacggaatctcttccggattcagatcgccatagctggtcaactgtttaaccgtgataccagtgaaatcctcatggaaagcaaatggtgcactatttcccaatacctggcccgcttttttgaaataaacgttctccaggttggtgccgacagtcatgatgctcttggtatttggctgccagatgtcatttgacaagtagcgcagtacgttctgcataaagtgcttcatgtcatcagaatcaccgctgagcgtacactcacctttactattaacaccaccgccccaactgtaaccgttcgggcaacgcaggatgctgttgtagtgcgggttaccgataaccatcagtttgccttcaccgacttgccccagcgaaataaacggcaggttgaaagtcgcagtatcgcgcgtaacgttctctggctgcacaatggaaggcgcttccgtaatgtacgccagctcatttttatcccaggcgcgtttttcgccaaacgccagccagtagtttttatcattacgcgccatcagaatcgggaatgccgagttggagatatttaccaccgcctgaccgcgcgcgttaccggtgctgccatagaagttggtagagtcatggaagacgtggaacttgctgacagactgatagttcgtatccacgccccacagcttgttaataacgccctgaatctggccgtcattaacattgcgcgttgtcagcgagaaccagcgagcctcgttacaaccgtcggttttcgcacaaatcgcggtatcgatctctttggcctgacccgtcttaaactgctcgataaattcgttaggcagcacaacgttttgatcgccttcatccagcgtcgcaccgttggataacgaaagattgattatctcgttgatcacgttgggatattcggcaaagaccttgcgtacatcgtccggaacaacacgagtattattttgaccagtcgtcgaataacgatgaatgagctgatcgatatttgccccgcgaacttcatcacccaattcagtcagcgcaatggtcgacttattgccacgtactgagcccagttcaaaggtatcgataccaaaggagatggtttcgccccagctaaaggaaaatttaccgttttcgtcagttacgccacggcctgaattggtgtagtagtcaacgccagcaacaccgttccccaggctatccaccagttggccttcggaaagaatgatttcagtgggttgatactgataaaactgttccgcgttagccgacacgaaggacgcgttcagatccggttttgttccctctgtcgtgactggcactaccgttgaggtatgggtggacggcgctttatcagtcgcagcattgttttccacctcttcattgaccagcttgctgaaattgtctgttgccagatcaatttgcttatacagtttttcaaatcgcgcgcgatcaaccactgacgagaaagtaagacaaagctgttctgcatctgcggggcaactgtcgctggacgtcaccagagagatggcgttggttttcttattttcagaattcgccagctcctgcgcgtcctccaggctaaacgacactttgtcaaccgcacgcaggctacgcgcagcttctgactgggtgttgaatgttgcaatggtcgtactgcccaccacacaactcacggtattgcctggcgtaaaggtaaagccatcgctggattcaccattacaggtagcaccagttacccgctggcttccgcccagggtcagataacccgttttcgtaggaacaggttctggctccggttctggtgtcggctcaggatcaggtgttggatccggcgtaggttctgggtccggcgtcggctcaggtgtcggctccggggttggtgttggatcgggtttcacttccggcaaagtccctgatccagaatctacagacggcgtatcggaggacgatcctgaaccaccaccatcacaaccggctaacagggttgcgcttaaaatagccgctaaaagcgatttcttatatttaaatttcttattcattaataacgcaagtgacaaaacaaagttaaaagattcgtaaccgaggaaatagttttatgctttatcttctttaataacttcctccattcttaagaaaacggcatcattgatagaaaaacaggtaaaatttataagaataacccctattcgatgtctggatggttatttttacgaaatttcaacaaacaaaaaattaacaaccattcacaacgtaactatataaatttgttggtagttttaacgattaagattgcaaaagcaacagatagaacggagtttgctcatcaagcgaacataattaatacagacttgttttgcgtgataaaaaatagatgttctcacgctcttaattatttagcatgttatctgaacgcaaaacattattgctgcatggataataaagcaggaaataattttccattaataagacagaataatgtaaacgaagccggatgatattaacgatcatccggcattattgacttacgaaactaacatcccggtaaacacatacgcctgcaacagcgtgataatgccgataacgctggcaaaaatcagactgtgcttcacggtgtagcggaacagttcagattctcgccccaccatgcccgtcgcggcgcaggccacggcgatagattgcggggagatcatcttgccagttacgccgccgctggtgtttgctgccaccagcagggtgtcagagacgttgatttgctgcgccgtggtcgattgcagtgaaccaaacagggcgttagaggaggtgtccgagccggtaaggaatacgcccagccagccgagaaacggtgagaaaaacgggaacatcacgcctgtacctgccagtaccagcgccagcgtggtggacataccggaatagttggtgacgaaggcgaacgccagcaccatgccaatcgacaatatcggccacttcagactaattagcgtttcggcaaagacgccaatccctttcttgatgcccacgccgaggatgaagatagagataatcgccgcaataaaaatagcggtgccgccagccgagagagggtcgaatttaaacaccgcgtccattggcgttggttgggcgacaatgggtgccgctttcaacacttgttgatgcaaatgagggatctggaaattaatcaccagtgaataaaacgcgccgcccggagcaaataacgctttaaacggcttcatggtccagatggtgaccagcaccgttaagattaaaaacggtgaccacgcacgaatgatttgccccagactatattctgaaggcacgggaccgccagaagatggtttattcaccaccatcgcacctgcggattgtcccatgctgattgccgtttcggtatttttcggccgccagactttaaggaataaagcgagtgagacgatactcaccagcgccgaagtaatatccggcagttccggaccaatatagttagaggtaaagaactgagtgacagcgaagcttccccctgcaaccagcgccgctggccacgtctctttcacccctttccagccgtccatcattgctaccagccagaacggcacaagaaccgacaggaacggtaactgacgtcccgccattgcgccaatgtggaacggatcgattcccgttacctgaccggcgaccagaatcggcacgcccaacgcaccaaacgccaccggcgcagtgttggcaatcagacacagccccgccgcgtatagcggtttgaagcccaggcccaccagtagagcaccggtaatcgccaccggtgcgccaaagccagccgccccttccagcagcgcaccaaaggagaaaccaatcagtaacacctgcaaacgctgatcgtcggtgatggagataaccgagctgcggataatatcgaactggccgctggcaacggttaatttatacaggaataccgccgcgacaataatccacgcaataggccataaaccataaataaagccatagcccgcagcagcaaatgccatatcaatcggcattttaaaggcgaatatcgcaatcagaatagataatataagggttattgctccagcgacatgtcctttcagacgtaataccgcgagtgcaacgaagaagaatattattgggatcagggcgaccagagcggatagccccagtcctcccatcggcatatacatttgggtccaggtaaccatattgttcagtctcttattatctttatatgcttgatatacttaaggttgtaataagcaaaagaggactgaactgtaaaatataggcgttatactttacagcaacagtacgccgctaacgcaattgctacctctggtataacaagtatatcgggtaagggtttctgttccgcacacgcaggcgcagagtatcgttaagatgtccatattgttgttttaatcccgctagtgatgcgctacgggtatttaatattgttaacccctgataatcgctccggttatttccgggataaatgtactaccgcagttactatcatagccccgacaataaatcttgccggggctttttttgacgctattaatgattttctttttcgcgtaaacgccatgcgtgtaataacggttcggtatagccgtttggctgtttcacgccgaggaagatcaaatcgcaggcagctttaaaagcacacgagttagcgaaattctccaccattggacgataagccggatcgccagcgttttgctgatcaaccactttcgccatattctccagcgacgcctgcacctgatctttggtcagaataccgtgacgtaaccagttggcgatatgctggctggaaatacgcagcgttgcgcggtcttccatcaacgccacgttgtgaatatccggcacttttgaacaaccaatcccctgctccacccaacgcaccacgtaccccagaatcccctgcacgttgttatccagctcttgttggatctcttgcgccgaccagttagcgttttcagcaaccggaatagtcagcagatcgtccagcagcggttcaaattcagcattgaactcggtctgggcaatgttggcttgcacgctctgtacgttggtttggtggtagtgcagcgcatggagcgtagcggcagttggcgacggaacccaggccgtgtttgccccggcacgcaattggtcgcccttctggctgtacatgtctgccatcaggtccggcattgcccacatgcctttaccgatttgcgcttttccacgtagcccacagaacagaccggaaagcacgttattacgttcgtaggctttgatccacggcgtcgatttcatctggtttttacgcagcatcgggcccgcttccatcaccgaatgcatttcatcgccggtacggtcgaggaaaccggtattgatgaacgccacgcggttgcgcgcctgagcgatacagctacgcaagttcagcgaggtccggcgttcttcatccataatgcccattttcagggtattcggtgccataccgagcattgtctcaacgcgggaaaacagtttgttggcgaacgccacttcctgcggaccgtgcattttcggtttcacaatatagacgctgccagtgcgcgagtttttctgcacttttaaatcatagagggcaatcgcgccagtcatgacaccatcaagaatgccttccgggatttcattgccttcgctgtcccaaatcacaggaatggtcatcaaatgacccacgttgcggataaacagcaacgagcgtccgtgcagagaaatttcagatccatcggcggcagtgtactgacgatcgtcattcagtttacgcacgatttgccgaccgttcttctccattttctcttgcagagtcccctgcatcaggcccagcaggttgcggtacagcaggattttatcttccgcatcaaccgccgcaaccgaatcttcgcagtcgagaatggtactgatggccgcttcgacgataacatcgttgatgtgcgccggatcgtctttgccaatccgcccgttggcatcgatttgtagctcaatatgcaggccgttatttttcagcaaaatgcaggtcggcgcagcagtatcgccacggtaaccgacaaactgtgctggagtacgtaacgtggtttctttaccatttttcaactggatgcgtaattgtttatcgaccaccttaaacgccaccacatcctgatagctgccattttccagcggtagtgattcatcgaggaaacgccgaacccaggcgataacctgctcaccacgctgcggatcgtagccgctgaccatcgccccttcctgcgggatgatgtcgctgccgtataacgcatcgtacagtgagccccagcgagcgttcgccgcgttcagcgcgtagcgggcgttcatcgccggaaccaccagctgtggccccgcctgactggtgatttcgctgtcgatgcccgtggtttccaccgtaacgtggtcaggctgtggcaccaggtagcccagttcacgcaggaaagatttataggccgctttatcttttaccggccccggattgctgcgatgccactcatcaagcgccgcctgaatgcgatcgcgctctgccagcaactgacgattctctggcgccagatcgtgaacgatctcatcaacattgtgccagaacgcggcagcatccagttccacgccaggcaaaacttcttcatccacaaaacgtttaaaattggcgtcaatgcgtaaacggccctgggttatggtttgactcattgtttatctcctcgttttcgcttatttcgccaacaccgctgctgccgctttcgcgacctgcgcatcctgtgctccggttaaaccagaaacgcccacggcaccaataatttgcccatccacaacaaccggtacgccaccttccagcgacgtcagtaacggcgcagtcacgaacgcggtacgtccgttgttcaccatctcttcatagcccttagtttcacgacgccccagcgcggcggtacgcgctttctcctgggagatgttagccgcaatcggcgcgcaatcgtccatgcgacttaacgccagcagatgaccgccgtcatcggcaacagcaatggaaacagaccagttatttttctgcgcctcttcctgacctgcggcaataattgcactcgccatttgctggctaagaatgactttagttttcattttgttattccttttcaagggcttgttctacaatttcaatccagtgacgcacagaggtacgaccggcgctcgccagatgcgtctggcaaccaatgttggcggtgacgatcatttccggtttgccgctttccagcgcattcattttgttatcccgcagctggcgtgccagatcgggatgcgttaacgcatatgttcccgctgaaccgcagcacagatggctgtcgggaacgtccgttaaggtaaatccaagacgaagcaacactttttccacttcgccgttcagcttttgcgcatgttgtagggtacacgggcagtggaaggccagttttttatcgccgcgaattgccagtttttccagcggttcctcgcgcagaagttcgactaaatcgaccgccagctcactgacctgacgcgctttatcggcatacaacgcatcgtttttcagcatctgcccatactctttgacaaacgcgccacaaccgctggcggtttgcaaaattgcctcggcacctgcttcaatcgcgggccaccaggcatcaatattattgcgcgcccgcgctaaccctttctcttgcgcattaagatgatagtccaccgcgccacaacagcctgcttcgttagctggcatgacgctgatccccagacgatccagcactcgcgcagttgccgcgttggtgttgggcgaaagcgtaggctgggcgcagccttccagcattaaaacccgacgcttatggcgcagtggtggacgcggtttagctttcacggtttcagcaggcagttttgctctgacctgttccggtaaaaacggtcgcagcaccagccctacctgcgtcagcgcacggaagaccgccggacgcggcactacctggcgcaatccttcgcgcagcattcgctccggcagtgggcgtttcactttctgctcgacaatatcacgcccgatatccagcaaattgtgataacgcacaccagaaggacaggtggtttcacaattgcggcaagtgagacagcgatcgagatgctcctgtgttttaagcgtgacttcgttgccttccagcacctgtttaatcagatagatgcgcccgcgcggcccgtccagttcatcgcccagaagctgataggttgggcaggttgcggtacaaaatccgcagtgaacacaggcgcgcaggatgctgtcggcttccagcgcgcgcgcgttctgccgcatctcttctgttaatcgggtttgcatagcctgctcctcaaagttccgcgtacatgcgaccggggttaaacacgccgcaaggatcgagctgctgtttaagctgctggtgatagcggaataaaggtgccggtagcggggcaaagccaccgtctccggcactaaaccgggtcgcatgaccgccagcgttgcgggcgatgcgatggatttgattatcatcggctgtcgatttcagccagcgtaacgccccgccccagtcgatcagttgctcgccgggtaaatccatcatcggcgcatcactgggtaatgaaatgcgccataaggtacctggtaacgagaagaacggcagttgttgttcacgcaattgctgccagaactgacctgcaacctcttcgccacccagcagttcacgcgctgcttttaccgatccttcgccgccctcaaggcggatccacaacgcattgtcgaagtaacataagccactaatgggtagcggctggagttgccactgggcgatttcattcatggcttcttgcaggctgatttcccgacgcaggctcagggaggcgcgcggtcgcggtaacactttcatcgagatttcagtgagcacgccaagacaaccgtagcttccggccattaaccgtgagagatcgtatccggcaacgtttttcatcacttcgccaccaaaacgcagatgttttccagtgccggtaataatgcgcgtgccgaggacaaaatcgcggaccgaaccactccacgggcgacgcggccccgccagcccgcaagcgaccatcccgccccaggtggcttcttcaccataatgcggcggctcgcaggggagcatttgcccggcgctctccagcgctgcttcaatcgccaccagcggcgttccggcacgcgcggttatcaccagctcggtcgggtcgtaattaacaatgccgcgatgacaacgcacatccagcgtttgcccggtgacagggcgacctaaaaaggctttactattgctgccctgaatcaccagcggcgttttatcgctaatcgcctgattcacctgctccagcagcgcctggctgtaatcacactcgcgtagcatcagaaacgctccagttcaggaaaaggtaaatgaccgtgatgcacatgcatggcaccaaattcagcacagcggtgtagcgtgggaatgttttttcctgggttcagcaaaccatcggggtcaaacgccgccttgaccgcatggaaggtcgtgatttcatcgctgttgaactgggcgcacatttgattgattttttcgcgcccgatgccatgttccccactgatgctgccgccaacttcaacgcagagttcgaggatcttcccgcccagttcttccgcgcgggcaaattcaccgggttcgttggcatcgaaaaggattaacgggtgcatgttgccgtctccggcatgaaagacgttggcaacgcgtaaatcatattgctgcgataaacgggcaatgccttccagtacgcctggcagggcgcggcgcgggatggtgccatccatgcagtagtaatccggggagatacgtcctaccgccgggaacgcatttttgcgaccggcccagaaacgtactcgctctgcttcgtcctgtgccagacggacgtcagtcgcacccgcgttcaacaagatgtcgttaacccgctcgcagtcttcctgtacgtcagactccacgccgtccagttcgcataacaaaatcgcttcggcatcgacgggataaccggcatgaataaaatcttccgccgcgcgaatcgacaggttatccatcatctccagcccaccggggataatgccattggcgatgatgtcaccaaccgcaagtccggctttttctaccgagtcaaagctggctaacagaacccgcgccacgggcggcttcggcaacagcttcaccgttacttcggtggtcacgccgagcataccttccgatccggtaaacagcgccagcaggtcaaaaccaggcgaatccagcgcgtccgatcccagcgtcagcgcctcgccatccagcatttgcacttcaattttcagcaggttatgtacggttagaccatatttcaggcagtgaacgccaccggcattttccgccacattgccgccaatcgaacaggcgatttgtgaggacggatccggcgcgtaatagagattatgcggcgcaacggcctgggagatcgccaggttacgcacgcccggctgcacgcgcgcgcggcgaccgatggggttaatgtcgaggatctctttaaagcgcgccatcaccaacaacacacctttttccagcggcagcgcgccaccagaaagcccggtgcctgcgccacgggtcaccaccggcacacgcaggcggtggcagacagccagaatcgccgtcacctgttccatctgcttaggcagaacaaccagtaatggacgcgtgcgatacgcgctcaacccgtcacactcgtaaggaatgatctcctcatcggtatgcaggatctccagtccagggacatgctcacgcagtgccatcagtaccgatgtgcggtcgacttcgggtaaagcgccatcaagacgctcttcgtacaagatgctcatgagtagggttcgctttgttgtgttgtgtggcagctgattttttcgcgctgcttctgtgaacagttattaagcgggcttttcgttttcgtctatctctttagctaccggtcagaccattttttttccagctctgtgaccttgctttggttaacttaatgttaaattgatgtaacataatcacttacgtgatgtgcgtgttttgcgagttaagaacagaaaaattggtcctacctgtgcacgaggtccgggaatgaaagatgaacgtcgccctatttgcgaagtggttgcagagagtatcgaacggttaattatcgacggcgtgttgaaggtcggtcagccgcttccctcggaacgtcggctgtgtgaaaagctcggcttctcacgctccgcactgcgtgaagggctgaccgtgctgcgcgggcgcgggattattgaaacggcgcagggtcgcgattctcgtgtcgcacggcttaatcgggtgcaggacgccagcccgctgatccatctgttcagtacgcagccgcgaacgctgtacgatctgctcgacgttcgcgcattactggagggcgaatcggcaaggctggcggcaacgctgggaacccaggctgattttgttgtgataacccgctgttatgaaaaaatgctcgccgccagtgagaacaacaaagagatttcgctgatcgaacatgcgcagttggatcacgctttccatctcgccatttgtcaggcttctcacaatcaggtgctggtgtttacgctgcaatcattgaccgacctgatgtttaattcggtgtttgccagcgtaaataatctctaccatcgaccacagcaaaaaaagcagatcgatcgccagcatgcgcggatctacaacgcggtgttgcagcggctgccgcacgttgcccagcgcgcagcacgcgatcatgtgcggaccgtgaaaaagaatctccacgatatcgagctggaaggccaccatttgattcgctcggcggtgccgctggagatgaagcaggggtgactgccatcaaatctgcttttcatacaatcggtaacgcttgtacggctccgccccaatgcgttccagcatgttattcatgcctgtattggtttcgaggatccatgacatttccagcgcatcgatcttccggcgggcaaacggatcgtgtaaggcttcaatcaataacagcgcaatcaccgggccgatgcggctgaactgatactcgtcccgcacgcccatcagcggcactcgcgcagttcgcacaccgctgactttcaaacgccacagcaattttgcccagccgaagggaaagagcgatccgttcagatcgacaatcgcctcgttgatgttcggcaagccaacaataaacgcgcagggtgcagaatcaatctcagcgatgtagatcatatcgtccggcaccagatatttaagttgatcgcccatggtcgcgaattcatgttcggtaaacggcacaaatccccagttgtgctgccagccagaattgaaaatctcacgcaggatctgcatatcttcggcaaaccgctggcgattgatgcagcgaatggtcacttttttgcgcacctgatccatcagtttttttagcgccggagagaaagtgagatcggttcgctgcatccaccacgccagtaaatcaatgcctttgtgataacccagttgttcaatatgcgcggcataccacggtttgccgtgtggcatcatcgcacagggcggagtgtcaaaaccttcaatcagtaatccgctttcctgattgatattcaggctgaaaggcccgctgatcttacttgcaccttgtgacttcaaccacgcttccgctgtaccaaacaacgcggcaaaaacctgcggatcatcaatggagtcaatcatgccgaaatgaccggtatcttcaccgtaacgctcacggtgcaaggtatcgatttgcgcggtaatccgcccgactatctgcccggctttttttgctacccacgcctgccagatgatatggtccgtccccggattcttcgcagacaaatgctcgctgcgttcaatgaataaagggggtatccagtttggatcatcgggataaagtgatgacggaaaagcgataaatgccttaaggtcttttttattaattactttttcaattttaatcatcagcagatcgcattccatatctctgtggataacaaataattaacggtgaaaaacaggttgcaacagcaacgaacggcatcttaataatcaacccaatgaatacaaacaaagaataaatagtatttattaatgattacgataaggtcaaagactacacagaagcgccacaatgcctcttgtcgatttaaggcgaccggacaaggctccttcttaatatattcacaaattaaatatcattcacaataaaaacaaaaaagccaaacttattatttaaatcaatgttcattttcacaccgatgaaaatactatctcatttatcttttatgcctatataatccaccgcattattgtcattttatttttgatatccaattttttcgtggtgtatatgtctaataaaatctttacgcattccctacctatgcgctatgccgattttccaacgctggttgatgctttggactacgccgctctgagtagcgccggaatgaatttttatgacagacgttgccaacttgaagatcaactggaatatcagacgttaaaagcgcgtgccgaagctggtgcgaaaaggttgttatcgctgaacctgaaaaaaggcgatcgcgtggcgctgattgccgaaacgagtagcgggtttgtagaggctttttttgcctgccagtatgccggcttagtcgccgtcccgttggcgattccaatgggcgtaggtcagcgggattcctggagcgccaaactgcagggtttactggcaagttgccagcccgcagccattatcactggtgatgagtggttgccactggtcaatgccgcgacgcataacaacaaccccgaattacatgttttaagccacgcctggtttaaggcattaccggaagccgatgttgtgctccagcgtccagttccaaacgatatcgcctacctccagtacacctccggcagcacccgttttccccgtggcgtcattatcacccatcacgaagtgatggctaatctacgtgctataagccacgatgggattaaattacgccctggcgaccgctgcgtctcctggctgcctttctaccatgatatgggactggtcggctttctcctgacccccgtcgccacgcagctttcagtagattatttgcgcactcaggattttgccatgcgtcctctgcaatggcttaaattgatcagtaaaaatcgtggcaccgtttccgttgcaccgccgtttggctatgaattgtgccagcgccgcgtgaatgaaaaagatctcgctgaactggatctttcctgctggcgcgtcgctggtattggcgcagaacccatatccgcagaacaactccatcaattcgctgaatgtttccgtcaggttaactttgacgataaaactttcatgccgtgctacggactggcagaaaatgcgctggctgtcagcttctctgatgaagcctgcggggttgtggttaacgaagtggatcgcgacatcctcgaataccagggtaaagccgtcgcgccgggtgctgaaacacgcgccgtatcgactttcgtcaactgcggtaaagcgttgccggaacatggcattgaaatccgcaatgaagcagatatacctgtcgcggaacgtgtggtaggccatatttgcatctccggccccagcctgatgagcgggtactttggcgaccaggtttcgcaagacgagattgccgcgacgggctggttagacaccggcgaccttggttatctgctggacggttatctgtatgtcaccggacgcattaaagatctgattattattcgtggccgtaatatctggccgcaggatattgaatacattgcggaacaggagccggaaattcattctggcgatgcgattgcttttgttaccgcccaggaaaaaatcattttgcagatccagtgtcggatcagcgacgaagaacgtcgcgggcagcttatccacgcgctggcagctcggatccaaagcgaatttggcgttaccgcggatatcgatctgttgccgccccacagtattccccgaacatcctccggcaagcctgcccgtgcggaagcgaaaaaacgttatcagaaggcttatgctgccagtcttcatgtgcaggaatccctggcatgaatcaaactgtcgcggtgacgggcgctaccgggtttatcggtaaatatattattgataacctgctcgcccgcggctttcatgttcgcgcattgacgcgtactgcccgcgctcacgtcaatgataatctcacttgggtgcgcggttcgctggaagatacacattcgcttagcgaactggttgccggagccagcgcggtggtccattgcgccgggcaagtgcgcgggcacaaagaagagatttttacccgctgcaacgttgacggcagcctgcgcctgatgcaagcggcaaaagagagcggcttttgccaacgttttctgtttatctcttcgctggcggcgcgccatcccgaactctcctggtacgcaaattccaaacacgtcgctgaacaacggctgactgcaatggctgacgaaattacgttgggcgtttttcgcccgacagccgtgtatggtcccggcgataaagagttaaaaccgctgtttgactggatgctgcgcggtctgctgccacgacttggcacgccagagacacagctctcttttcttcacgtcaccgattttgcgcaagcagtgagtcagtggttaagcgccgaaactgtacagacgcaaacctatgaattatgcgatggcgtcgccggaggctatgactggcaacgtgtccaacagcttgttgccgatgtccgctgtggttccgtgcggatggtcggtattcctcagccgctactcacctgccttgcggatatcagtaccgcgttgaaccgtctggcgggtaaagaaccgatgctgactcgttcgaaaatccgtgaattaacccatgccgactggtcggcaagtaataaccgtatttctgaagatattaattggtttcccgggattagcctggaacacgcattacgcaacgggctattttgattgtcttgtttaaaggtgtgttaacgtttctatggtaaatcgtgaaatagtaatggattacatcctttcctgtttacaggatttggtcgaaaacggtgtggaaattaagcccgacagcgatctcgtcaacgatcttggcctggagtcgatcaaagtgatggatctcttaatgatgctggaagacagattcgatatttccattcctattaatattctgctggatgtcaaaacccctgcgcaattaatggaaactctacttccatggctggagaataactaatggggctatacgataaatatgcgcgccttgctggcgagcgcctgcaatttagtgacaacgggttaacaccatttggcacctgtattgatgaagtgtattccgccaccgaaggccggatcggcaataaaaaagtgattctggccgggaccaataattatctcggtttaacctttaatcatgatgctatccgcgaaggtcaggcagcgttagcggcccaaggcaccggcaccaccggttctcgtatggcaaacggcagttatgcgccgcatctggcgttagagaaagagattgccgagtttttcaatcgccctaccgctatcgttttttcaaccggttataccgctaatttaggcgtcatcagcacacttgccgaccataacgccgtggtgttactggatgccgacagccacgccagtatttatgacgcctgttctctcggcggcgcggagattattcgtttccgccataatgacgtcaacgatctggaacggcgcatggtccgcctcggtgaacgggcgaaagaggcgattattatcgttgaaggcatctacagtatgctcggtgacgttgcgccgctggcagaaattgttgatatcaaacgtcgtctcggcggatatttaattgtcgatgaagcacattcgtttggcgtgttaggcgctacggggcgcggactggccgaagctgtcggcgttgaagacgacgtggatattatcgttggcaccttcagtaaaagtctggcctcgattggcggttttgctgtcggttcggaagcgatggaagtgctgcgctacggcagccgcccgtatatttttaccgcctctccttctccgtcctgcattgcgaccgtgcgctcgtcgttaagaaccattgcctcacaaccagagctgcgccaaaagctgatggataacgccaaccatctgtatgatggtctgcaaaaactgggttacgagttaagttcacatattagcccggtagtgccagtaataatcggttcgaaagaggaaggtttacgcatctggcgcaagcttatttcgctgggcgtttatgtgaatcttatcctgccacctgccgcgcctgctggcatcacgctgctgcgctgtagcgtaaacgctgcccacagtcgtgagcaaatcgatgccatcattcaggcatttgctactcagaagcagtaatgtgaacccgccgtggtgttgcgccacggcgggtttaatgttgtctgtcataccaatacaccaggctcaacgccaccagcacaaacgctaccggtaaaccgagcgcggtaacaggtgcgctcaacgcaaatagcaatcccagattgaccatgatttgatagctgatccaggtgagtaaaccaacgatgacgcctacagcgagacggctacccatccctggcgagcgcgggacactaaaggtaaacggcacagccagcaaaatcatcgccagagtcaagatcggttgccccagtttttcccacagtgcaaggtggtattcgctgctgggttgcccggtatcctgcaaataatggatgtaatgattaagctgacggacagaaaaagtattccccggcatcgataactcttcaagattcatactggtgaaggccgattgccaggcaagattatctaatgtttccagcgtttctttgccattcaaccattttttataattcacaccatgcaggatccacgttttatcgtcttcaatggtggcactgcgcgcataaatgtaggattcgagcgagagatcgtcgcggtaatgaaaaatctccacgcccaccggctggccctgctcgttcagcgatttcaccgtcacaaattcattaccgcgcctggcccaaagcatattgccgataatgtcattgtcctcccccaacgcggtggcagtcgatttgatttgcagcgcctgttgctgcaatggtgacgccacccactcatcaatcgcgcctaacgaaacagtccacagtatccctgcaaccagcgccaccagtgcaatgcggaagatagaaaaccccgtgctgcgaatggcggtaagctcactgtttttcgataactgcccgagaccaacaatcccccccaataacgcgataaacggcgaaagttcgaccagtgtgcgcggtaaggtcatcagcaccaccagcactgcctgagtccagcgataaccgcccggactgacatcatccagttcgttaatcaggttgaaggtggtaaaaagcggcagcaatagccctgcggcggcggcaaaaccgagaaagaggtgacggattaaatagcgactgaaaacattcatcggggaaatttctgcagcaaggagaagtcgcgtgcgaccagcatcaacaggcccattagcatgagtccgggcactaaccacaaaccaggaatgaggggaatcgcgccgttagccaccagcgtacgacagacgtcgccgccataaaaaatggcaacaaacagcaacgtcagtggcagtagcgttgaaaatcgcccctgccgcggttttacccgacttaatgaaatggccagcagcgccatcaacaatgctgtcaggccacggctttgtcgccattgcagttcggcatgatcggctggaaagacggagcgtgccagctccgtgaccgattttgctttgcgtttgacgttagggctttgatccagcggattgagatgcaattgcagattacggtagatctgttcgttgtcgtcacgcccctgatgatcgagaagataggcggtaccgttatgcaacataacggtcggtttctcgggtgatgggtcaaccacatcaaccgaacgggcgcggaaaatgcgggttcgattggcagtagaagtataaatcagcgcgtcagtcaggcgattattatcctgatcaaccgtctgcgaaaggatcattcgtccgttatcgttagtgttaaatttctttgcccgcaactgacgaacatccagctccgactgcgattgttgctccagttgataaatctgcgcataagcccagggacgaccatacatcgacagaagggtgacaaaaatacttagcggtatcgccagataaaggacggctttgtacaaacgtcccggactgccccccgccgcggagatagcggtaatttccgagtcggtatacatttgccctagcgtcacgccaactgacgcatacagtccaacaggtaacagcatctccagtgcaatcagcactttgtagaaaacgatatccagcacaacatcaagagctaatgtcccatttgccgcttcggtcagataacgctgtgcggagtagctggcgaaaataaagatcagaaaaccgacgataatcagcaccagacggcgcgtaccacgcatgatgtagtgttcaaccagcttcatctcgctaacgccctcaatcctttgaattttttattcattgatcagtttctgcgccagcgcaatgacatgatctacctcttccggtgtcaggctgccgtcctttgcccactgaattcgcccggctttattcaataccagaatggttgaactctgctccggcaattgccaggcaacgcgtcccagaccattgccgtcaataacgaattgcgcccacggatagcggcgtttatttttttcgattttgccaacgacaaaatagccagtaccaaagatggcatcatcggtgttcacaatagtggtgggctgaaaacgatcctgcgaaaagtttgccgcttcaaccgctttaattaacagtgagttctttttcttcgcagacttacgtccggcgatatactgaataatgcggacttttcccgtcaattgtgtgctgttccacttttggtagtgaatttcgtcgtcgctattcagaagcagctcgccgccttcctggatataaacaggagtaaccgttttgccagtgacgaaattgtgtgccgccgcgcctggcgctaagagtgcgatgatcagagcgacaatccaacgagatggcattattgctccggatagagtgggaaacgcgaaataagcagttctaaacgctggcgaatatcgctatccagcgccaccggtgcatcatatgaccgacggttatccatatcatccgccaccatgtcgtcgtgcttatcccccatcagaccattaatggcggcgagaaaacgggaaatcagtaacgcctctttattttcaggatcaagcgatcttaaggtgtcgtaataagaaacctgctggctgatgatttttcgcacatcatgaaattccctgccagttagttgcggtttagcaataatctctttcaggatgtacatttgcttctggcggtaggcgataaaaccgttcacggtttctaactggccatggcgcaatgaatagttcaccagccaccagacaggggagctcaaataaacacgtaacaggttaccgtaaaacgacacaatatttttcttaccgttacgaaagccatcctgaaaatgcccaagaaaaacggtcgttttgccgaataaaaatccggcctgatgcttctttaaatacagccgttgcgcaaaacgcagatgcttgtagcgcgctcgcatgtatttaaactgtttgcgctcgtctgtcgtcagctcatcgcctttcgcctgtttgcggattaaacgcagtaactcctgacgattaacaccatccagccagaatttcaggcataacgcgtaattatcatggatgatttcggtggtacaacttagtgcgatagtcggcggcaaactgacctgtgcatcaacaacatcatcttcttcaatcgcaacaaatagacgctcgctcgcctcaagcgggaaatattttctcatcatcaggatttctctccggttgagttataaagcaaggaatggcgctgaaaaaatgcctttaaggtcggaattagcgagagcaccacatccagacattgcccaccgaagtaagcaaatgcagcccccagcacgccaaacagatgacagaacatgaacagcaatacgatgtagccgattgaggcgatggtttgcgccacgagaaaagcgcgctgttttcccgccatcaatagcaatgactcctgtgggaagcccagcatcgaaatcacaattgcgcccagcatcacctgaatcaggtcatacgcttcgagatacttaacgccaaacaccagcgaaatgagcggcttgccgacgatcaacaccgcgagcgccaccagaataccgattccgcccgccagtaaaccggacttcacgcctaacaaccacggtctggtggtgcgtggatctaaacgcatcacctctggataaaaacttttgcccagtaaacccgctggcgttccggcggcatcgaagaatgtcatggcgattttaaataacccggcggcagcgggtcctaacacgatccccaccaacactgtgctgcacgagttacgcgccgaccagatggagtgggcaatgttggttgaccagacaaaactccacgcgcctttaatgtgtcgggcagactcaaacagattcaatttgaaggcgttatggatatttctgcggcgtaattcgcgcgcggcaaaccaccagtacatggtgccgccaaccagattcgacacgtaccaggcaataacaaaacccgcaaaaccaaagtcaaaataccaggctacgacgctccccgctgcgcgcagaaaaggtttcgtcgcctgctgtacagcaatcaaatcaaagcgatctaccgcacgcagaatgccggtcggcgtggaggaagccattgaaggaatgagcgtgcaatagagcgccgccagccaaaagctttggtcatccagacctaatgaatgggaaaggaatggcagtaaggcaatgccgccgacaatcgccaccgcgccgctgacgatatccagcgagaaggaaaatgagacaacattgcgaaattgctgcggatcattgttggtcaaagctggcgttccgtactgaactaccagctgccatgtctgaaacttaataaaatcgctgatcgacttggcgtacgattgcacaattaccagtacgccaaacatggcgggcgtcatccctttaccggcacacgagagcgccaacagccccagcaaagcgctcacaacattactggagcctaaccaggcgctattgcgaataatggtgcgaaacgcgccatctgcaaaccaatgtttgatgttaaaaaccgccaattcagcctgaccttatcgttgatagtaaaaagtatcccgccagccttaagttaaacttcggcggtcagaaacgatggcaaccagagaaaccgccttctgtgcctgttccagcacctcgctgtaaggcgctctggaatcaatctcaagaatttttgtgccgttatagccaatcgtcgacataacaccgattttgtcctgcagctcggcatagtcatggtcaggcttgcgggagatggcagtatcaatatcaatccccaagcgaatgattaattcaggacggtattgcgccattttttggtataaacgccgttcacgctgcgccagaaacctgctgattttcccggtcgcacgttcgacgccaatccccggtccgtcataataaaagcccgaaatttcagcctgcgggaagcgatcgctgaccaccagaacgccactttgcgccagtcgctgaaccttgcgcagattcgccattcttcgcagcgagaagcagtacataatcaccgccgcccatagcgccggagatttggttttcatgctttgggttttcgaggatttggccgccagtcgccgttcgagccagacaccaaccaacggcaatcgtttgattttgtcgccgtcttcgccggagagcagccccagatagcgccgctcggtttgccagtgttgttgcagcgatttcaccaggtcatttgtcagtgtggatttaccggtgccatcacacccgaccaccgcaatcagccccggaatgtagttgggctgcggcgcggttgtactcttaacagtttgtgtttgtagtgcatccattcgtttaatcatcccctatccattttggtgatcaggaaagcgcggcgtgaattgcgcgtagtgacgcttgcagaatttcatcggctggttgccgaccatccagttcaaggatcctggcgccattgaatgtcagttgcggcgtaacggcgattttttcctgtaacgctgccagttggtggtcaggtttacgcgcaaacgcggtttgttcatcaatgccaagacgaatcaacaatacaggcaaataagacgccatccattggtacagcttcagctcacgctgccttaacatttttatccaaccgttaccgcccgtggtttttgccaattgcgggccatcaaagcggaaacccggcacttcaacctgcgggtagcggtcggtgatgagcagatagccttgctggtttttacacaacattttgcgaaacttgtacgcccgccagcaggaaagcagatagataaccagcgcagtaatattgccaggcggtgttgagggcttttcgtgcacatgtgccgctttacttcgcaaataacgcccaaaaggtgcgccaataacaggtagctgtgaaatccattcgccaattcgcccggacgattgcccgagataaatgtgttctgttggcattcttgatgccagttcatttaccaggcttgccgtgagggtcgatttacctgaaccatcacatcctacaatggcaataacacgcactggcgtggaattaattattgacatattacgttgattcacgaaaaacccggcagcaaataatgtattgaatattacgtggtccgtgctcagaatatccgttcaaccttattgtgacaatggttaattgtgacattgacctgaattacgctttcatcaaaaacatattaaccaaataaatattttggatggatatttaaatttaaggatatattcatgcagtcaataatacctccattaattgccgttattggtagcgatggttcaggcaagtcaacggtgtgtgaacatcttattaccgttgtcgaaaaatatggtgctgccgaaagggttcatttaggaaaacaggccggaaatgtcggtcgtgcagtgacaaaattaccgttgatgggaaaatccttacataaaacaattgaacgaaatcaggtaaaaacagcaaaaaaattgcctggaccagttccggcgctggtaattacagcgtttgtcgcccgtcgcttactgcgctttcgtcatatgcttgcctgtcgtcgtcgcgggttaattgttttaaccgaccgttatccgcaggaccagattcctggcgcttatgatggtacggtgtttccgcctaacgttgaaggtggtcgttttgtctcatggctggcaagtcaggaacgtaaagcatttcactggatggcgagccacaagcccgatctggtcatcaaactcaatgttgaccttgaagttgcctgcgcgcgtaaacccgaccataaacgggaatcgctggcgaggaagattgccataacgccacagttaacctttggtggtgcacaactggttgatatcgacgccaatcagccactggaaaaggtgctggttgatgcagaaaaagcgattacggattttatgaccgcgcgtggttatcactagtgaaaaatggaaatgcccgatcgccaggaccgggcattttcaggaaggttaaatcaactgcaatgctatccagtacaacccaccagaaagaaaaatcgccgccggtaaagtaaatacccacgccatcaggatgctggttaccgttttacgctgtaacccaccgccgtccaccaccatcgttcctgctacggcagatgagagtacgtgtgttgtggagacgggcatcccaatataactggcaaggccgatagacactgccgccgtcatttgtgccgccatgccttgcgcatacgtcatgccgcgcttaccaatcttctcaccgatggtcatcgctacacgacgccagccaatcatggtgccgatgccgagcgccagtgctaccgccatgatgatccataccggtgcgtactcaatggtgcttaacatatcgctgcgcagttttttcagcaggttctggtcttctttactgacgcctggcagtttcgccagcttcgcggaggtatcagagatgcacagcataatgcggcgcagctggctgcgctgactcacgcttaacggctcgtaactttccatattgcctggcagcatcgttttaacgcgcgcaatcgcatcaaaggtatttgccggatgacagtgaaactccgtcacttgcgcgccatcagtcgatgccgcaggcaatggaggttccatcgtaatcaacttctgcggcagttcaggatgctgttgcaggtagtgttcgaagttggtgacggcatcgcgggtacgggtaatttcatagccggacgcattcatattgacgacaaacccggcgggagcaatccccaccagcaccagcatcaccagaccaattcctttctgcccgtcgttcgcgccgtgcgaaaacgccacgcccgcagcggaaacaatgagggcaatacgcgtccagaatggcggcttacgtttgccttttttctttttgcgatcttcaggaatacgatgaatacggtcacgctttttcgtcccactccagaaacggcgtagcagaaaaattagcccccccgcaatcaccagccccacgatgggagagacaatgagtgaagagaaaatcttggtgacttcgcgcaggtttaacgcatccatcaccgacgagccggttaacagcgcgttggttaaaccaatgccgataatcgcaccaatcaaagtgtgcgaactggaggccggtaaaccaaagaaccacgttcccaggttccagataatcgccgccagcagcatggaaaagaccatcgccagaccgtgagttgaccccatattcagcaacaaatcggttggcaacatatggacgatggcataggcaacgctaagcccgccaagcaatacgccaaaaaagttaaaaaatgccgccatgaccacagcaagctgtggttgcatggcacgggtataaataacggttgccaccgcattcgccgtgtcatgaaaaccattgattgcttcatagaacaacacaaatgccagagcaagtaataacaaaagccccgtatatatatcaaggccaacaaataaatttagcatatattagattacgccattttgaatttacgaacggaggcattatcagtgactttcacggcgtgggcaaagtgaaatatcattttttaacgataaaaagcgtgttatttcttgtgtatcagacaataagccttcattcaaaacctttagaaataatcaaaacacaggtatttcacttgttaatatattcatatataaaatgaataaatattgaaatatataaatattgaatattttgattaatccccgtactgattattcttcataatcagtacggggttgctacaacatgtattactctttcaccacaattaacggttcaatatcactctcttttttgatgaccagtgattcatcaccgcgcaaacacgtcccaccgtagttgccgccaacggtgaaagtacatacctgaatgtatttaccgtccactttcggcaaacaccacagttgctggtaaatatttttctgttcggcaaatttaccactggttttgtccagcacctcttcatgatggctgaccaggtcaatgttgctaccacagcgcccggcaatcggtttaacggcataaccggttttaaccagctcatcattcacggtgaagtcagtatccaacagataacgatggtgcgggaacagcgaccagaggatcggcagaatcgctttgttgccggggatcaccgtccacagcggctcaaagaccagcacttccgggcgcagcaatacgtcgataagacgcacttcattttgcggatgaccggtccgaatcggcactgcggcaaattcacggtcgctcacttcgcggatttgatcaaatgccgtttcccacgcccaggttttccatacgcagttaacctgtcgcccttctccatcaatcagttgcccggcagcatcccaacgcagttcctctaacccgcgtaaaatacgcgtttcaaagcctgcttgttgcagcgcctgctccataaactgcgcgtgatagttttcctcgatatctttgtcctgcatgatatggacaaacggacgtgcacgactgtgtttccaggcaccagccagttcgttaatcagtccttccgcaggattgaagccgttgcctttatagccctgctccgcccaacgttcgaggatcaagcccgcttcggtatgacaggaggcagaatcggcgttgtattcgtagactttcaggccacgttcatccatgcagaaatccatacgaccagtgatcatatgatgacggcgacgctgccaggagagacgcaaacgtggccagaggattttcggaatgtcgaacaacgccagcaggttgtcatctttcagcaccttgtcggtggcgtgaagatacatcaggtgcagctcgttggtggctttaatcaactcctgctcggcgctctcggtaatggtgtagtaatgatacggatcctgattgatcacctgaccgttggcctgtacataggcgttttgcagcggatctttttcatccagccatttaccgtcaaactggcctttgttttccagacgcgccccgctgattttcagcagttcgcctgcaatttccggctgtggcaagctgtattcggtatcttccgtctggatcatccagcccagaatagtggtgtcatcgaaggtgtctttcagggtatagccgccgttttcgaccaccatctccagctcgcgtgtccactgttgtccttgcggcaacggggtatgaatcacgttctgttccgcaatacggactttgttgccatgcaattgggtaatgatggcgacatggccagtgtctttaaattcaccgcctttatcccagataagaagcgcccccgctaccggtgcacgcggcgaaccgttaggaaatgcctgcaatggcaggatgttgtcattgaccacttcacgcaggaagcgcagtgagaaaatctcccatgccatacccacgtcagtgaagactacaccgtagttcagaaagagaaaacggcgagcaaattcaacgcattgccatttgtggcccatatattcatcgtcgatatagctacggaatacggcgtcatcttcgtattcctgcggatcgagagaactgtaatctgaagagtagattgctaccccacctggggcgtagcccaataatgtcccgaacggggcatcctggctggtcgttcctttgctcatcactttacctttaacaatacaacctaagcagttggcgtaattgttgtgctctgattacctgctcagcgacattaaccggacagaggtcagactaatcatacacctcatcgcagcggctggcgcaaagggttaaaaaattcacattctgtacagcaagtgacctgctacactgcttcaacactaccactcagaaggcaactcactatgacagacaatacttatcagcccgcgaaagtctggacgtgggataaatccgctggcggcgcgttcgccaatatcaatcgcccggtttctggtccgacgcatgaaaaaacgctgccggtgggcaaacatccattgcaactttattcgctgggaacgccgaacggtcagaaagtaacgattatgcttgaggagctgctggcactgggcgttactggtgcagagtacgacgcctggctgattcgcattggcgatggcgatcaattctccagcggctttgtcgaagtgaacccgaattcgaagatcccggcattgcgcgatcatacccataatccgccgatccgcgtgtttgagtcaggctcgattctgctttatctggcggagaaatttggctacttcttgccgcaggatctggcaaagcgtactgaaacgatgagctggctgttctggttacagggcgcggcaccgttcctcggcggtggttttggtcacttttaccattacgcgccggtgaaaattgagtacgccatcaaccgctttactatggaagccaagcgccttctcgacgtgctggataagcaactggcgcagcataagtttgttgcgggcgatgagtacaccattgcggatatggcgatttggccatggtttggcaatgtggtgttaggcggcgtatatgatgccgcagagtttcttgatgcgggcagttataagcatgtacaacgctgggcgaaagaagtgggcgaacgtccggcagtgaagcgtgggcgtattgttaaccgcatcaacggaccgctgaacgagcagttgcatgaacgccatgacgccagtgatttcgagacgaatacggaagataagcgtcaggggtaatggttagcgttcgtcgcagcaagccatccagaccaatgtaggccggataaggcgttcacgccgcatccggcaatcgagcacaatgcctgatgcgacgctgccgcgtcttatcaggcctacaaaagctaatcatcacgcgctggtaatgtcgtaatccatttggcgcagtgcgtctaatgtggctttggcttcgtcttcatcgataatgctcatggcaaatccgacgtgtaccagtacccactggcccagcagatcggcagggttaccttcacaaatcagggcgatattcacgtcgcgcttgataccacatacttcaacctgcgcaagctggtgaatatcttcaccgacagccagcacctggcctggaacgccaatacacattgttaactccggttattcaacttcaatacttttgacgattagcgaatcgccggtatcgacacgcaaccgctcgccatgacagatcggacactgcgcatcgtgctgatgaatctccaccacctggctgcaatcccaacaccaggcctgggcgggtttatagacgatatgtaaatcgcacccttgcgctaccgttccgtggcagacaatttcaaaactaaaacggacggcgctctcctcaacgcaggagagtgcaccaatttccagccacacggcggtgacgcgcttaacatcgtgctgctccgcctgccgttggataatttcaacggcgctctggcaaagcgacaactcatgcattttcgccactcctgcggccaaatagcagggcacgacgccctgcgtgtggtacatccggattggtgactggcagcgaaaggatcattcgggcgcagtcatccgtcagccgttggccctcttcaatcgacatgctgtgcgaaagcggcgacatcagcgagcaggagaggtattgcgaaacaccatccagttcaccaacagtaaaggtcatagtgccatacggcagttgcagaccaattttttcactcactttgcgcagcggccagagttgatccgggccggggaagataactgcactcagcatccacggggtgatcacacaccccgtccactgaccttcgaacagcgtaaagtcagaaacatacaccggcattgaaggatgcagaaaagagagatcatgcatcgaacgccgggcaatttcttcaaaagctgcctgtacttgcaccttcggggaggtctggaaacctgctatctcttcagtcatgagtcgcctcccgtgggatagcttccacgcctgattcgcgcagcgcagccagaacctgctcaagcgcaggttcaatcatcgcttcgaccgtcggcgtcaaaccgatgtgcggctccagtgattccgggatcacgccgaccagggtcagctttttcggaaactcgccggtgaagcgcagggccgacaatacgtcggccaggccaagctgatgcggagagattttgttggtaaacaacgccggaacttcttcatcccgcaggatcatcatcgttcccggcgcgttctttttcgagacaatggcatccgcaataatcagatgatcgcgatttgccatgtcgccaagcagctccattcccgccgtgccgccatcgaggatctcaacataatccggcagaatgtatcgttgctctaacgcttcaacaatccgcacaccgatggcttcatcggtcagcaaaatattgccgacccctaagactaaaatacgcattacagaaccttcactgaaaccacttcgttgccgtcggcatccactacgtgtaccgcacaggccatgcacgggtcgaaggagtgaatggtacgcaccacttccagcggtttattcggatcggcaaccggtgtacccaccagcgactgctcgtaaggaccgacgtcatcattgaagttacgcgggccagagttccaggttgatggaacaactgcctggtagttgctgatgataccgtctttgatcaccatccagtgagagagcataccgcgcggtgcttcgaggaagcctacgcctttgaactcacccgttgccggaatgttcggcttcacaaaggtggtgtgatcgcctttgccgatattggtgatcagtgcactgtattgattttgcaggatatcctgcaattcacagcagtgaacggtacgaccaataatacggcccagcgtggagtgcaactgcgccacttccagcgtgttgccagtcagtttctgataaatcgcaacgatttcattcagtttgttctgggtagactcgcgtcctgccgccagtttcaccagcatattagccagcggacccacttctaccgttttgccgtagaaagtcggtgatttcacccaggaatatttaccgtcgtcagaccaaccatcataagccggaatggtggtaccttcccacggtgcctgcggcgcttcgtctttataccaggagtgcttcgcgctttcctgaatccctttgatcaggtattcatcggaatgagaagtgatcggacgatacgaggacagatccgcattctcaatgtagccgcccgggaacaggaagctgccatttttactgtcggtcgggaattccggcacgctcaggtagttcaccgcacctttaccgcgcgtcagccattccgggtagaacgcagcgataactgcagtatcaaccttgtaaacctgctcaacaaagtcgctcagcttgtcgatgaaggacttgatgtacatcaggcgctcaaggttcagcacacccagaccgtcgaggttgatcgggttcgcgacaccacctaccgccaggttctgaatatgcggcgttttaccgcccagcagcgccacaacgcggttagcgtcacgctggcactccagcgcctgcaggtagtgcgctaccgcaatcaggttcacttccggcggcagtttcattgccgggtgaccccagtagccattggcgaaaatacccaactgaccgctggcaaccagatctttgatcttgttctgaactttggtgaactcttccgggctgttcagatgccaggtcgaaacgcctttcagcatttcggaggctttggtcggatcggcttgcagtgcagaagtgatgtccacccagtccagcgccgaaagctgatagaaatgaacaatatggtcatgcgtggtgtgcgcagccagaatgatgttacggatgtattgcgcgttaaccggaacgtcgatattcagcgcactttctgccgcacgaacggaagacagcgcgtgagtggtagtacatacgccacagatacgttgcacaatcatccatgcatcgcgcggatcgcggtttttcacgatctcttccatgccgcgccacatggtaccggaagcccatgctttcgaaacgacgccattttcgatttcgcaatcgatgcgtaaatgcccttcaatacgggttaccggatcaatagtaattctctggctcatgctttgctcgcctcatgacgattatgatcgttttgttttaaaggaggaagtatcggcagtagacgaatgagtacgatataagcgcaaatctcaatagccacaaaaccaatagaaatcaacagttcttcccaggtcgggaagtaggcgtaaccgccacccgggttgaatgccaccagcgaataggtcagacgccaggttgcacaacctaacagtgcactcagtgctgacaggaacagcatgcgggaatcattacgcaacttcgccacacgcagaacgaccagcgggaagagcatcagcaggacttcaatccagaacatcacggagtagaagtcaccggcaaacgctaacgacagcttgtcgcgatagataagctcgccaaagcgcagcacgatgaaaatcgccagcaacacactgatggtattggtcagcttaacgaacagactcttttcatccggaccgttgccacgcagacccgcctgcaccaacgaaccttcaaagatgacaatcgagaagcccatgatgaacgccgtcagcagcgagaacagcggcaacatttcatagctttgccacagcggatgcaccttgtagcccgccgagatcatcagcgatcccattgaagactggtgcatagttggcagcagcgcaccaagcgcgatgataaagaacatcaccttgttcagacgtttgagtgacagcttccagcccagacgttcaaacaatgccggagcaaactccagtgccatcacaccgatgtagatggtcatacagaccgccgtctcgaacagtaccgagttcacgttgaagtgacccggaatgtagaagtacggcaggttccagtagcgacccacgtcgatagtgatcgacaagccacccagtgaataaccaaacagactcgccaacagcgccggacgcaccagcggatggtattgcccacggttaaagacgtatactgcccacgccagcgcccagccgccacaggcaaagccggtaccgatcagcaggtcaaacgcgatccacacgccccacgggaagccgccgttcaggtcggagacagagcccagaccgaacaccagacgcttcacaatcaggagcatacagatgacgattaacggtccaaaaatcatgaccggtttactgatgattttgccgcccagcggttgtggatcatgactcatgatcgtctcctccgtcgtgatggtcgtttttagtgttgcgacgaaccagcacggttaagcccgccagcacagccagtggtagcatcatgcctttatacagggtgtgttggacatgttcggaacgcgcaccagtagaaagatcgtccagtttcggcaggtcgagattttcataaggcacacccgtcagtaccagaacctgagtaccgccgccctctttctcgccgtacagatgcggataatatttcggcaccgtatgcaggtaagtgtcgccagatttcagcgtctgacgcggatagtggtattcgctgcccggcttcagcgccagacgttttttcgcctccgccatcagctcttcacgcgtaccaaaaatcaccgcgcccgccgggcacacttctacgcagccaggcagaccgcctttatcgagacgttccacacctttctggttgcacaactcgcacttatgcagcgcaccaaacgggttgttgtagtcgtacttcggcacgttgtatgggcaggcgaccatgcagtaacggcagccggtgcacacatctttgtcgtaatggacaatgccggttttcggatcttttttcagcgcagagaccgggcacacagagacacagttcggatcgacgcagtgcatacactgtttcttaatgtacgcgtagccattctcctcctggtctttgttgacccctgtgccgctggtccacacctgaatgatgttattggtatacggcgacagtttgtcgttgttcgaccaggtctgttccccttgcgggttacgttcagggaagttgatatcctgacacttggtgacgcaagcctggcagcctacgcacaaggtcgagtcgtacaacatccccagcgatcccggaattggcgggcggttttcagcagccgcatgactgacagacggcagcgcgcccgtcagcaatgccccgcaggaggctgctttaataaaattacgtctgttcacggttattctccccgtgagtcagcgttatctttcttttgctgacgacccagttcacgcaccgccatcacgctgacaccggcaaccagcccaaccacaccgccgagcaaaccaatagcgcctgccgagacgttgccgccttctttagcgttaacgtccggtttctgtgaacgcggagtctggttttcgacgttggcaagctgatggatgcctttatggaagccgataccttcttcgttacagccatagcacgggtgaccaatcgctaccggccacacgccgccaacatcgcagaattgcagcgttgagcagttgccgtaagtttctggccctttacagccgaggtggtacaggcaccagccttcgcggtgaccttcatcaccgaactctttggcaaaacgaccagcatcgaagtgcgggcgacgttcacagtgttcgtgaatcagacgaccataggcgaaagtcggacggtttttgtcatccagtttcggcggtttgccgtaagtgatgatgtgcgcaacggtcgcgaggaagttgtgcgggttcggcgggcagccaggaatattgataacggttttgcccggtagaacttcttgcaggctgactgcgccagttgggttaactccagctgcggcaacaccgccccacgcagagcaggaaccgatagcgataatggctgctgcgccttccgccgctttgcggatgtgatccacaatcggctcaccggcaaccatgcaataaataccgttatcttttaatgggatggaaccatccaccactaacacatactgccctttgtacttctcgagagcgttatgtttgttctcttcgacctgatgaccgaaggcggcggaaagcacttcgtgatactccagagagatagtctccagcacgaggttttctaccgttggatgcgttgcacgaagcagagattccgtacaaccggtgcactcctgcgcgccaatccagataactggcggacgctgcgggttagtaaccgattcggccatctctgcagcggctttgctacttaaccccatggtggcggctaatgctgcacaaagcttcatgaaatcacgacggttaatgccgtgagaatggatgagggtgttatctccagtcatttatagttattccgttgcgaagacctggcatatattttgcctcaatcgcaaaatcaataatgcgatcgatgcgccatttaccacacatttattatggttatcgatatcatgatactgcggcggggcactaaaacgaagggaagaagcattagtgtaattaattaaagcaagataatacgtatgtttgatcaattttctaggcgataaccggccataaaaaagcgcaacgtagaacaggaattattctcacgaaagaaatccattaccatctctttatccagtccataacggcgcgtcagaatacccgcttcccaggcgctaagctggcgatctccggtcttttcgtacatccggtgtgagtagcctaatacaaaaccgcgtttataatcggcacagaattttgtcacattaaccgcactgtcagcatgcgttgcttttaatcccgccattaagcctttaccaaaatggttattcatcgttcacctcattcgttatatattgtcatatatatcgatattttaggcaaagaacgacatttgcgcacgctattttttcatgcttgtttaagacgtaatcctgtaagagataaacccatcaggagagatatttatcgaaccatttcagcgtcctttgccaggcaagatcggcggcagatttgtcataacggggcgtggaatcattatggaatccgtgattaacctccggatatatatacgcctcatagaccttattattggctttcaacgccgcctcgtaagcgggccagccctcgttgattcggctatccagttcagcgtagtggagcagtaaaggcgcttcaatcttcgccacatcggcagtgggtgcctgacgcccataaaacggcaccgcgcaggccagttccggatacgcgactgctgccgcgttcgatacgcccccgccatagcaaaatccgctaatacccactttgcctgtcgcttgcggatagcgttgcataaactcaattgcggcaaagaaatcattcatcagtttggttggatcaacctgctgttgcagttcgcggcctttatcatcgttaccaggatagccacctactgagcttaaaccgtctggcgccagggcgatgtaccccgccttcgccactcgccgcgtcacatcttcgatatacggattcagccctcgattctcatgcaccactaccacggctggcgttttgccgctcatttttgcgggcttcaccagataaccccgtacctcgccgtgaccatttggcgagggatacgtgatgtactctgcaacaatttccgggtcggtaaactctacctgagtcgccagcgcataatttggcttgagcaaatcaaacagcgctaatgccgtcatcccgcccactgcatacttcgccgcaaggttgaggaactcacgtttcgagattttcccgtgagcgtaatagtcgtagtaatccagcaactcttgtgggaaatctttggcggttaaacgcggcatcgttgcactcctcaactggtgtttttttaagcaaagcataagcgcgtgtttttgcccagtttttcgtcactctgtgagccagactacgggatacgcgctggcgaatcgctaaactagaaacattgtttcgaaattgaatggtggaaaggagaggtcatggtctggttagcgaatcccgaacgttacgggcggatgcagtaccgctattgcggaaaaagtggtttacgcctgcccgcgttatcgctcggtttatggcacaatttcggtcacgttaacgcgctggaatcacagcgtgcgatcctgcgtaaagcgtttgatttaggcattacgcactttgatttagccaacaattacgggccgcctccaggaagcgcagaagaaaactttggtcgcctgctgcgcgaggattttgccgcttatcgcgatgaactgattatctctaccaaagccggatacgatatgtggcccggtccatacggctctggcggctcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcattcggtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgcattgcctttactccactggctcagggattgctgaccggaaaatatctcaacggtattccgcaagattcacggatgcatcgtgaagggaataaagttcgtggtctgacgccgaaaatgctcaccgaagccaacctcaacagcctgcgcttattgcatgaaatggcacagcagcgtggacaatcaatggcgcaaatggcgttaagctggttgctgaaagatgagcgagtgacgtcggtattgattggtgccagccgcgcggagcaacttgaggagaacgtgcaggcgctgaataatctgacatttagcaccgaggagctggcgcagattgatcagcatatcgccgatggagagctgaatctgtggcaggcgtcttccgataaatgacctgttaataacgggcgcgagaaccgcgcccgaatcagatcagtgattatgacgagtcagtcggtcaagatagcccatcacaaatgcagagagcacaaacgtcagatggataatgacgtaccacatcagtttgttatcagggacatttttcgcatccataaagacgcgcagtaagtgaatggaagaaattgccacaatcgacgctgctactttgtttttcagcgacgttgcgtccattttccccagccagttcagcttctctttgttctcggagatatcgagttgtgagacgaaattctcgtaaccggaaaacatcaccatcaccagcaaaccgccaaccagcgtcatatccaccagcgacagcaacacgaggatcaaatctgattccgccatcgagaagatattcggcagtacgtgaataatctcctggaagaacttcagcgccagggcaactaacgccagcgaaaggccaaagtacacgggggcaagcagccagcgagaagcatacattgcattttcaagaaaacgttccatacattcctgtcgtgtagttaaaacgggcaacagtatatcgcaattaagtaaacagcacgcaacagcaaatcaacatatacgttaaacctttgtcgcataattctgagggttagggatcttcctggttcccttatcaacgcatcgagagcgtctacccttaaaggacgttgaacctgaagggagaaaaatgatgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaatcggtcgcgctgccgccattgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaattcgcccgttcgctggttcacgaagcacacaaggcgttaggcgggctggatattatggcgctggtagccgggaaacaggttgccattcctgatattgcagacctcaccagcgaacagtttcaaaagacctttgccattaacgttttcgcgttgttctggctaacccaggaagcgatccccctgctaccgaaaggtgcaagtatcatcaccacttcctcaatccaggcataccagccaagcccgcatttactggactatgcggctacgaaggcggcaattctgaactatagccgtggcctggcaaaacaggtcgcggagaaaggtattcgggtgaatattgtcgcgccaggcccgatctggacagcactgcaaatttctggcggacaaacgcaggataagatcccgcagtttggtcagaaaacgccgatgaagcgtgcggggcaaccggcggagctggcccctgtatatgtttacctggcaagtcaggagtcgagctacgtcaccgcagaagtgcacggtgtctgcggcggcgagcatttaggttaaaaaaatgcccggttgtgaaaagcaaccgggcatcatttttatttcgctttcgcagtttcttcgccgaccagacctattttcaggtaacccgcctgatgcagcgtatccattaccttcatcaacgtctcgtaatcgacagttttatccgcacggaagaagatggtggtgtctttcttgccttcggttaacgcattcaacgccgtaatcattgtttcatcggtgaccggatcgttaccaataaacatcgagttgtctgctttcaccgacagataaaccggtttttccgggcgcggctgcggcgtgctggtagaagcaggcaaattcaccttcacatctaccgtcgctaacggtgccgccaccataaagataatcagcaaaaccaacatcacgtcgataaacggcgtcacgttgatatcatgcatttcgccgttatcgtcgaggttttcgttaagatgcatcgccatcggacattatcctgcacgtaatttttgtgcgacacgaaccggatgcgcagcggcgctggcttccagatccaggtcacggctttgcagcaacaatacctgcgctgcaacatcacccagcatcgctttaaagccgccaatctggcgtgcaaatacgttatagataacgaccgcaggaatcgctgccacgaggccgattgccgttgctaacagagcttctgcaatacctggcgcaacgactgccaggttagtggtctgcgtttgcgcgataccaataaagctgttcatgatgccccagaccgtaccaaacagaccaacgaacggcgaaatcgcgccgatggttgccagatagccgttaccacggcccatttgacgacctactgcggcgacccgacgctccagacggaagctggtacgttctttaataccttcgttatcgtcgctgccttctgacagttccagctcattctgcgcttcattgagcaaatgcaggctcaagcttttgctaccaaaatcagcggcgatatcgttggcctggtttaaggaacgcgcttcagccagcagttgctgctcgcgcttaagacgacgcttctgattgaagaactccacgctcttactgaagaaaattgcccaggtgactacggaggccaaaataagcccaatcatcacgcacttaacgacaatatcggcgtgctgatacataccccagacggagaggtccgtctgcattaaattattacccactgtgtatctccaggacgcaagtcacaaaatctgtgcataataatatcaaaacgacgtcgaattgatagtcgttctcattactatttgcatactgccgtacctttgctttcttttccttgcgtttacgcagtaaaaaaagtaaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacacgctcggtgcggtaaatagcgtgattcagcgcgcgtcttcgctggtctttgacagtgtggaagccaaaaaacacgcgacacgtaatcgcgccaatggcgagttgttctatggacggcgtggaacgttaacccatttctccttacaacaagcgatgtgtgaactggaaggtggcgcaggctgtgtgctatttccctgcggggcggcagcggttgctaattccattcttgcttttgtcgaacagggcgatcatgtgttgatgaccaacaccgcctatgaaccgagtcaggatttctgtagcaaaatcctcagcaaactgggcgtaacgacatcgtggtttgatccgctgattggtgccgatatcgttaatcatctgcagccaaacactaaaatcgtgtttctggaatcgccaggttccatcaccatggaagtccacgatgttccggcgattgttgccgccgtacgcagtgtggtcccggatgccatcattatgatcgacaacacctgggcagccggtgtgctgtttaaggcgctggattttggcatcgatgtttctattcaggccgccaccaaatatctggttgggcattcagatgcgatgattggcactgccgtgtgcaatgcccgttgctgggagcagctgcgagagaatgcctatctgatgggccagatggtcgatgccgataccgcctatataaccagccgtggcctgcgcactttgggggttcgcctgcgtcaacatcatgaaagcagtctgaaagtggctgaatggctggcagaacatccccaagtagcacgagttaaccaccctgctctgcctggcagtaaaggatacgaattctggaaacgagactttacaggcagcagcgggctattttcctttgtgcttaagaaaaaactcaatgatgaagagctggcgaactatctggataacttcagtttattcagcatggcctactcgtggggcgggtatgaatcgttgatcctggcaaatcaaccagaacatatcgccgccattcgcccacaaggcaagatcgattttagcgggaccttgattcgcctgcatattggtctggaagatgtcgacgatctgattgccgatctggacgccggttttgcgcgaattgtataacattgccacttttggacaattttgcagacattttattgtgaaaagacttaaattgttgcgtccgggatcaaggcgtcccggacgattcaggagtacaataggcagataaaggcttaaacgctgttccacaggaaagtccatggctgttattcaagatatcatcgctgcgctctggcaacacgactttgccgcgctggcggaccctcatattgttagcgttgtttactttgttatgtttgccacgctgtttttagaaaacggcttgctgcccgcctcatttttgccaggcgacagcttgttgatactggcaggcgcattgattgcccagggggttatggattttctgcctacgattgcgattctgaccgccgcagcaagtctgggctgctggctaagttatattcaggggcgctggttagggaataccaaaacggtgaaaggctggctggcacagcttcctgctaaatatcaccagcgcgccacctgcatgtttgaccgccacggtctgctggcgctgctggctggacgttttcttgcatttgtccgtacgctgctgccaaccatggcgggaatttccggtctgccaaaccgccgcttccagtttttcaactggttaagcggattgctgtgggtcagcgtggtaaccagtttcggctatgccttaagtatgattccgttcgttaaacgacatgaagatcaggtaatgacgttcctgatgatcctgccaattgccttgttaaccgctggcttgttgggcacgctgtttgtggtgattaaaaaaaaatactgtaacgcctgacgattttccccgttcccggttgctgtaccgggaacgtatttaattcccctgcatcgcccgcattcttgccgcatcttcccccggcgtcacaccgaagtaacgtttaaactcacggctaaattgcgatgcgctttcatagccgacgcgcatcgccgccgcgctggccttcatgccgtcgtggatgatcatcatccgcgccttatgcagacggtaattcttcaaatactgcaacggcgaggtgctggtgacagacttaaaattatggtggaacgccgatacgctcatgttggcttctgccgccagttgctcgacgctcaggttttcggtgtatttattctcaatccgtttcagcacgcgactaatcaggctgaagtgagtctggcggctgaccagtgccagtaacgcgccgccgcaaggtccggtcagcacgtagtacagaatttcgcggataatctgtttgccgagaatgcgcgcatccagcggtcgctccatcacatccagtaaccgctctgccgcgcataaaatctcttctgataacgtggcggagttaataccgctggctgccattgacggctgaaaatgttcatcttcgccaatgtccatcaacagttcctgtaactgcaaaatatcgacattgagacgcaaccctgccaacggcacctctgacgtggcataggtttcgcactcaaacggcaacggcaccgtcagcaggagatattcattagcgtcataacgaaacacgcgttcattgatataaccgattttatgtccggaaaagagaattatgatgccaggctcgtacatcaccggtgtgcgtgcgaaaggcgtctcgccatacaacaaacgcacatcgggcaacagctctgacaaactattttctttatttttcagtttattaactttatccgccagcaagcggcaaatctcttcacgtttcatatcgcgtaatttcttaggaataatgcggcaatttgattgtgcgcaattttgtagcatttctccagcactctggagaaataggcaagacattggcagaaatgagcattgagaggtacggcgctggcgaccacaatgaaaaacatcaggcagaccgatctctgccctcatattgacccagcaaagggagcaagtaatgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgaaccaaacccggcttatgaaacgctgatgaacgccgtgaaactggttcgcgaacaaaaagtgacttttctgctggcggttggcggcggttctgtactggacggcaccaaatttatcgccgcagcggctaactatccggaaaatatcgatccgtggcacattctgcaaacgggcggcaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagcccgtatttgccgtgctcgatccggtttatacctacaccctgccgtcgcgtcaggtggctaacggcgtagtggacgcctttgtacacaccgtggaacagtatgttaccaaaccggttgatgccaaaattcaggaccgtttcgcagaaggcattttgctgacgctgatcgaagatggtccgaaagccctgaaagagccagaaaactacgatgtgcgcgccaacgtcatgtgggcggcgactcaggcgctgaacggtttgatcggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttcagacgatgagcgtattgacgccgcgattgccgcaacccgcaatttctttgagcaattaggcgtgccgacccacctctccgactacggtctggacggcagctccatcccggctttgctgaaaaaactggaagagcacggcatgacccaactgggcgaaaatcatgacattacgctggatgtcagccgccgtatatacgaagccgcccgctaagctttttacgcctcaaactttcgttttcgggcatttcgtccagacttaagttcacaacacctcaccggagcctgctccggtgagttcatataaaggaggaacgtatggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcagcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctatttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcacccgctgatgcaacaacgccagctacatgcctggaacgcgacacacaaaatccagaccgaatcctggagcccattagcgcaaggagggaaaggcgttttcgatcagaaagtcattcgcgatctggcagataaatacggcaaaacccctgcgcagattgttatccgctggcatctggatagcggcctggtggtgatcccaaaatcggtcacaccttcacgcattgtcgaaaactttgatgtctgggatttccgtctcgacaaagacgaacttggcgaaattgcaaaactcgatcagggcaagcgtctcggtcccgatcctgaccagttcggcggctaacgtgcaaattctcccggtggcggtaatgttccgctaccggacttttcagaaatcatttattcccctcgcgtcccgcccgttgctactcttccttgttcaggaatgccaaatataaggacatcatcatgcagagccggaagctcttaaaagaacaactcatctatatccgggataaacgcaacggagaggtgaaaaacagatgaaaataatacttctgtttttagcagccctggcaagttttaccgtacacgcacagcccccctcacagaccgtagaacaaacagtccggcatatttatcagaactataaatcagatgccactgccccttattttggtgaaaccggagagcgagcgataacttctgcgcgtattcaacaggcgcttaccctgaacgacaatcttacgctgccgggcaatattggctggctggattatgatccggtttgtgattgtcaggattttggcgatctggtgttagaaagcgtagcgataacccaaactgacgccgatcatgccgatgccgttgtgcgctttcgtatctttaaagacgataaagaaaagacctcgcagacactgaaaatggtggcggaaaatggtcgttgggtcattggcgatattgtcagcaatcatggcagcgtcttacaagcggttaatagcgagaatgaaaaaacgctggccgctatagcttcgttgcaaaaagaacagccggaagcctttgttgccgaactctttgaacatattgctgattatagctggccgtggacgtgggtggtttccgactcttaccgccaggcggtcaatgccttctataaaaccaccttcaagacggccaacaatcccgatgaagatatgcaaatagaacggcaatttatttacgacaatccgatctgttttggcgaagagtcgttattttcacgcgttgatgaaattcgagtcctggagaaaaccaccgattccgcccgcattcatgttcgctttacgctgaccaatggcaacaacgaagagcaagaactgattttacagcggcgcgaaggtaagtgggaaatcgctgattttatccgcccgaacagcggcagcctacttaagcagattgaggcaaaaaccgccgccagattaaaacaatgagctgaattaaataacaattagccggaacaataaataaaagggaacactatatgaaaacgattttcaccgtgggagctgttgttctggcaacctgcttgctcagtggctgcgtcaatgagcaaaagatcaatcagctggcgagcaatgtgcaaacattaaatgccaaaatcgcccggcttgagcaggatatgaaagcattacgcccacaaatctatgctgccaaatccgaagctaacagagccaatacgcgtcttgatgcacaggactatttcgactgcctgcgctgcttgcgtatgtacgcagaatgataaaaaaatccccggcagcattctgttaccggggatattttttaacgtccaaccgccgctttagggcgtttcttcgcaccagcattctgcaggcgagattgcgtagacgacgctttttttgccgtagcaggcgtctgacgctgggtcgccatcggcgtatgtttagtcaacgccggacgggtattgcggttctggcggcgagcctcacgcatctcttcaatggttggcgcaggcactaagcaatcgcgacggctgccaatcagatgctttttgcccatcgcttccagcgcctggcggattaacggccagtttgccggatcgtggtaacgcaacaacgctttatgcaggcgacgctgcttgtcgcccttcggtacgaagacgtcttcactcttataaccaatcttcgccagcgggtttttgccggtgtaatacatggtggtcgagttagccagcggcgacggatagaagttctgcacctggtcgaggcggaagcgatgctttttcagccatagcgccagattcaccatatcttcatcacgcgtacccgggtgcgcggagatgaaatacgggatcagatactgttctttacctgcctgtttcgagtaagtatcgaacagctctttaaagcggtcatagctgcccatgcccggcttcatcatcttcgataacggcccttcttcggtatgttccggggcaatcttcagataaccgccaacgtgatgggtcgccagctctttgatatagcgcggatcttctacggcgatgtcataacgcacaccagaggcaatcaggatctttttaatgcctttcagatcgcgcgcacggcgatagaggttaatcgtcggttcgtggttagtgtccatatgcggacaaatatccggataaacgcacgacaaacgacggcaggtttgctcagcgcgtggcgatttgcaacgcaacatatacatgttggcagtaggcccaccgagatcggaaatcacgcccgtaaaacctggaacagtgtcgcggatcgcttcgatctcattaataatcgaatcttcggaacggctctgaataatgcgcccttcgtgctcggtaatagaacagaaagagcagccgccaaagcagccacgcataatgttgaccgagaaacgaatcatttcgtaagccggaattcgggcattaccgtaagccggatgcggcacgcgcttgtacggcagcgcaaagacgctatccatctcttcggtagaaagcggaatagcaggcgggttgatccatacatagcggtcgccatgtttttgcatcaatgcgcgggcgcagcctgggttagtttcgtggtgcagaatgcgcgaagcatgggcgtacagcactttatcgcccttcactttctcgaaagaaggcagcaacacgtaggttttttcccacggtttcgggcgtggtggctgcacggttacagctttggcttcctgctttttcggagctaccggtttgttatccgcgcacggcaaatcttcgccatacggatgcgggattgggtcgattttccctggggtatcaagacgggtggaatccacaccgctccagccaggcaacgcctcttttacgataatcgcggtattacgcacatcgcggatttcactaatcggctcgcccatcgccagacggtgcgccacttccaccagcggacgctcaccgttaccaaacatcagcatgtcggctttcgaatccaccagcacggaacggcgcacggtatccgaccagtaatcatagtgcgcggtacggcgcaggctggcctcaataccgccgaggatcaccggcacatctttccacgcctctttacaacgttgggtataaaccagtgtggcgcgatccggacgcttacccgcgacattatctggcgtgtaggcatcgtcatgacgtaaacggcgatcggcggtatagcggttgatcatcgagtccatgttgccagcagtaacaccgaaaaacagattcggtttacccagacgcatgaaatcgtctttactgctccagtctggctgagcgatgatccccacgcgaaagccctgcgcttccagcatacgaccacaaatcgccatcccgaagcttgggtgatcaacatacgcatcacctgttaccaaaatgatgtcgcagctatcccagccaagttgatccatctcttcacgtgacatcggcaaaaacggtgccggtccaaaacaggcggcccagtactgcggccaggagaacaggtcgcgatccggttggatcagggagatagagctcattttgcttccagaaatggtaaaaaaataatcaaaggccggggattatacgctgtatcacacgcggaaatgaagtgatgttgatgaacggtggcgaaataccctggtgaggtttttcactgcccgacttgggcaagcacatttaaggctggcggtatcgtggcaactgccgctactatttatgccgatcagcaacgttcaaatcatattgcacgacgatcggctatccgaggacacccacagtaaggcaaggtatggaacaggttattacaaagcgccgctattacgatattggtctacagattgaagagctgctgtattcaggcgtatttaaggccggagaacgcttaccttcagaacgtgaactgagcgagcggtttaataccagccgaactaccattcgtgaagccatcattatgctggaactgaaaggcgtattgaatgtgaagcaagggtcagggattttctttgtcgactccaccgataagctcaaccagaaatcattaatgccctattcagaaattggcccgtttgaactgttacaggcacgtcaggtaattgagagcaatattaccggttttgcagccagccagattagctttaacgagttacaagagttaaagaaaatcattagtttgcaggaaaacgctatcgctgcggaaagtgatagatttgaagacctggatcaccgatttcatagcattattgccgaagcgacgcaaaatcgggtactcatcaaacaagctgctgaattatggcgggcagttcgtacagaaaacccccgctggaagaaacttaactacaagtacctgcatgaaaagcatttgcgtctgcaatggctggaagatcaccgggctattttcctggctctgcaacagaaagattcagagctcgccagggaagcgtcctggagacatctggaaaacagcaaaaatgaactgatcaaaatcttcaaacaagacgcttccatcagcgattttgatgactttttcttcgctcgttaaccttcattagtccagagctggcgggaaaaataacgccggctctgcctttcgccctccactggtacacgctctctttttaattggtctaataaatcgactatcatcagatatcttagattagcggcaattatcctaaaaactgacctctaaaaaactttcctttcattttattcatataactcattgatacagatataaataacgccttgttgttctgtttcgtacttttacctttctctgcaagcgtgatgcatctctctgtttttggtctagtgaattatgtaaattggtctacacacaagtcgtcaggagtaagagcataatgtcagggaacgaaagtatcgctgccgcccactatgatcaggtaaccacctggcctcgggacgggttacaggcagatattgtccatattggttttggcgcttttcatcgcggacaccaggctgtctacacggatctcgctaatcaactttcggacacccgctgggggatctttgagatcaacctgtttggtgatgctcaactgatcgaaaacttaaatgcgcaaaatgggctgttttcggttgtggaaacatctgcatcgcaatctacctcacgccttgtgcgttcggtggctggcggtattcatacccccagagatggcattgccgcagcaatccataaactggctgaacctcaggtaaaaatcgtttcattaactatcaccgagaaaggctattgtctcgatccgcaaacgcgatcacttgatctcaccaatggattaatcaaccacgatctacaaaatccggatgcgcctcagtcggctattggcgtgatcgtctgtgctttgcaacaacgtaaagcggcaggactcgccgcttttagtgtgctctcctgtgacaacttgccagacaatgggcatctgacgcgcaatgccgttctcggttttgcccgacaactggaccagcccctggctcagtggatcgaagaaaatgtctcatttccaggcacgatggtcgatcgcattgttccggcaatgactgaatcgcaattcgccttactggaaactaaaaccggttatgccgatccctgcgggatcgtctgcgaatcatttcgtcagtgggttatcgaagataattttgtgcgcggacgaccggaatgggataaagccggcgcgatgtttgtcagcaatgttcagccttatgaagagatgaagttacgcatgttaaatggtagccattcatttctggcttataacggctcactggctggctatgagtttatctggcaatgcatggaagacgctaattttcgttccattacccaccaactgatgattaatgaacaagcccgaacacttaatccagacttaaatatcaacatccaggaatacgccgacctgttaattgaacgctttagcaaccgtaacgttgcacaccgtaccgggcaaatagccatggacggttcacaaaagcttccccagcgtgcactgacgccctggctgaaattgcatcagcaaaaacaaaacaatgctgttctgtcactgctcgttgctggttggttgcattatgtcattgatgctgttgagaaaagccagtctgtcgctgatccaatgaatgaccaatttcaggcgctaataaaggaacaacaagacgcatggcaacaggcgctcgcattactgcaccttagcgccatatttggtgatttaagcaaccatcagccatttataaatgaaataaaaatcgcctttgcgaatataaaaaacaaaggcatcaaggccaccatcagccaattattatcggatgagcagaaatgaaaacattaatttgtcagcagcctggcgttatggaatatgtggaaaaggatattcccacaccagcagataatgaagtgctgttaaaaatcaaagctgtgggtatttgtggtacggatattcacgcttttgccggcagacagcctttttttagctacccacgtgtattaggtcatgaaatatgcgccgaagcggtttcgcgaggcagccagtgccaaacagcacaatcaggccagcgctattccgtcatcccatgcattccgtgtggcgagtgcgcagcctgtcgggaagagaaaacgaactgttgcgaacgtgtttcgctgtatggcgtgcatcaggatgggggttttagtgagtaccttgcggtacgtgaagacaaccttgtgcctctccctgacgaggtcagcgacagtgccggagcattggttgaatgtttcgccattggtgcacatgccgttcgtcgggcagagatcaaggctgaacaaaacgtactggtgattggcgctgggccaatcggtctggctaccgcagccatcgccagggctaaaggggcacatgttgttgttgctgatattgactgtcaacgtcgccagcacgttgtggatcatctggcaattaatgtcttcgacccaacacaggaaggttttattgccgcgcttagtgaagtgtttggcggcgaactggcttgcgtagtcctggatgcgacgggaaataaagcttcaatgagtcatgatgtcaatcttattcgtcatggcggcaaaattgttttcatcggtttgtatattggtgaacttgttattgacgatccgaccttccataaaaaagagacaacgttactcagcagccgcaatgccacacgggaagattttgcgttggtgattgaactgatgcgcagcaataaaattcacgaaaatttaatgaaaaaccaggcgttcaatttctttagtgttggcgaagattaccagcgtaacgttgtagaaaataaaaatatggtcaagggtgtgatcactttttaagggaacaaatatgacaactgtttatgtcagtgaagaaaatttaaaatcactggtgcaccacaaattacataccgccgggctggataccgacaccatacaacaggtgacagatgttttagtacatgccgatattaccggtgtgcattcacatggtgttatgcgtgtcgaacattattgcacccgccttgctgccggagggttaaataaagccccgcagtttagcattgagcaaatttcaccgtcagtggccattctcgactctgacgacggaatggggcattccgcattaattagcgccactgagcacgctattaaactggcccagcaagagggcctcggttttgttagcgttaaaaacacgtctcactgtggtgcgttatcttattttgcagagatgatcacccacaaagggttggttgctatcgtaatgacgcaaaccgatacctgtgtggctccccatggcggcgccgagcgctttttgggaactaaccccatcgcctttggtttcccggtggaaaacagccatccgatgattgttgatatggcgaccagtgccacggctttcggcaaaatacttcatgcaaaggaaaccggaaaacatattggtgaagggctggcgatagataaaaacggttatggcaccactgatccgtataagattgaaaacctgctacctttcggccaacacaaaggttcaggcattgcactggctattgatgcactgactggcgtgctgatgaatgcgaattttggcaaccatattgttcgcatgtatggtgattatgacaagatgcgtaagctggcaagtttggttattgccatcgatccgaaaaagctcggcaatcctgtttttgcaaaaactatggcgaaaatggtcacggagctgcatgccgttaaaccggctcctggtgtcgaaaaagtgttagcgccgaacgatccgcaaatgcactacaaagaaaaatgccaacaggaaggtattccggttccggcaggaatattccattatctggcagagaattaatcactattttttattataacgatagaaaagcgctgtatttatcgtttctgttatattaaccaggagcaggatatgaaagcacttcgtcctctgacggcatcgcttatgctgttaaccagttgtttattaatatctaataccacactggcaaaaacaacattaaaactgagtcataatcaggataaaagccatgctgtccataaagcattaagctatttagcggataaaaccaaagagtattctaatggtgaattagttattcgcatttacccaaatgcgacattaggtaatgagcgtgaatcactggaattaatgaactccggtgcattacagatggttaaggttaatgccgcatcactagaatcatttgctccggattacagccttttcagtctgccgttcttattccgcgaccgtgatcactattatcgtgttctgcaaagtgatttaggtaaaaaaatacttaattcatcagaaagaaaaggttttgttggtattacgtactatgacggcggtgcgagaagtttttattccaataaaccgattacaaaacctgaagatttagcgggaatgaaaatcagggttcaacaaagccccagcgccattgcaatgatgaaagcactcggtggtgtcgctaccccgatggcgcaaggcgaactctacaccgcacttcagcaaggtgtggttgatggcggagagaacaataccgttgtctatgccgatatgcgtcacgccgaagtcgcaaaagtctattcacgtgatgaacacaccatggtacctgatgtgttaattatcagcaccgacgtgttgaataaacttggtgataaagagcgcacggcattattaaaagcagccgatgagtcaatgatgcagatgaaggacgtcatttggcctgcggctgaaaaagaagcctacgacaaaatgaaagggatgaacgcaacagttgttgatgttgataaatccgctttcaaagaacgcgtcaaaccgttatacgatgaattcaaggcgaaagatgcacaatcagccaaaaaccttgagctagtagaaagtatgtaaccctaatgggcaggtaattcctgccttttcatggaagacttatgcgaacactcactcatattcttaataagatccttgccggatgttgctgcattattctcgccattatggtgttctgcgtaacctggcaagttattgcacgttttatttttaacgctcccagcactgtgcttgatgagttcacccagattttatttatgtggatgattttgcttggcggtgtatatactgcgggtttaaaaaaacatctggccattgatttgttggctcaaaaacttccggctgcatctgttctgacgcttgacagttttatccaaattattattacggtctttgcggttattttcatgatctatggcgggaatattgttgttgaaaaagcacaacatgttggacaaatctctccagtattaaaatggccaatggataaagtatattgggttatgcctgtcagtgggcttattctggtctggtattcagtaatgaatattattgacaactatcgtaaacggaattctcattaacgagggaaatatggaatttgaatatatctaccccgtcttaattttatttggcagttttgccgtcatgctggcaataggtgtgccaattacttttgcgattggtctttcttcgctgttatctattattactgccttgccacccgatgccgccatttctgttatttcacaaaaaatgactgtagggctggatggctttacgctattagccattcccttcttcgtgttagccggaaacattatgaataccggtggtatagccagacgactggttaacctggcgcaagcattagttgggcgtcttcctggctcactggctcattgtaatatcctcgcgaatacactgtttggtgcgatttcaggttcagccgttgcgtcagccgcagcggtaggtgggattatgtcaccactgcaagaaaaagagggatatgatccggcgttttcagcagcggttaatattgcctctgcccccattggcctgatgatcccaccgagcaatgtgttgattgtttattccctcgccagtggcgggacttctgtcgctgcgttgttcttagctggatatctgccgggcatcctcaccgctgttgccttaatgtttgtagctgcactttatgcacgacgtcaccattacccagtggccgaacgcatcaattaccgtcagtttttacaggtattccgcgaatcaattcctagcctgatgcttatttttatcattattggcggtattatcgcaggggtatttacgcccacagaagcatcagcaatagcggtaatttatagtttagccctggcgatgatttaccgggaaatcactcttaagaagctcaatgatattctgttagattcggtagtaaccagttcaattgttctgttactggtaggctgttcaatgggaatgtcatgggccatgacgaatgctgatgttcctgagttgatcaacgaactgattacccgcgtttcggataacaaatgggtcattctgtttattatcaatatcattctgttgatcgtcggtacctttatggatatcacgccggcgatcctgatatttacacctattttcctgccgatcgcccagcatctggggattgatccgattcacttcggcataattatggttttcaacttaaccattggcctttgcacaccacctgtcggcaccattctgtttgtggggtgcagcattggtaaggtcagtatcgacagggcaataaaaccattactgccgatgtttctggcattgtttgtagtaatggcaattatttgttatttcccgcagcttagtctgatgctgccaggattattttcgacctgatacacaatgaagactgcatactgagtaattttcaatgccccaccactctgtggggcattgaattggtccattacggtaccggattgaccaacagttgcccaatcgagccacggtccgccatttccagcgtctgactgttgaagtagaacgggaagtgcgcccaggaaggctgaccgaaataaacaagcagctccacttgtccgtcaacccaaacggtatctttccagcctctgtcttccgggaacggcatcgcgccattcacgttacggatctggaacatcacgccttcaatatggaacgcttgcggctcgtccgcgcgcaccgtccagcgttcccacgttccttgctgcgcagtaacatcaatacggttgacgtcccacaactgcccattaatccccgggtcatcacccaggctgatatcacgacttcgaatcggcgaaccggccatgatttcagttggcagcaagcgcatcggaagactgtctgtgaccagcggcagaaggccggttgggcgcagcgttagcaccagcgtagaaaccagaatgctggatggctcaaagaagccacgaatacgatcaacaatgctcgccgcttcgccacaggtaatcgacacttcatcaccgttgctcatatccaccagaatctcacgacgctcgcccggtgccagcgaaagttgcttcaccgatacaggagcgggcaggaatccttgatcgccagaaatcacatgtaacgggcgaccatcgctcatctgtagttgatagcgacgagagttcgacgcgttcaacagacgcaagcgcacccagccacgcgagacttcaacgtacgggctttgtacaccgttaaccagtagcgtatcgccaacaaagccgccgcttcccggttcgttatattctggcgtaccaaagttatccagccgtttatcctgaataatgacaggaaaatcatccacaccataatggttggggataggcagcgatttactgacttcatcttccaccagccacattccggcaaggccgttataaacctgctgagccgtgcggttgggagtattggcgtgataccacagagtagctgcgttctggcgaatgggcagtacgggtgcccagtcagcatttggcgacatcatccgtgccggaccgcccatcagcgggccaggtacctgtagcccggccaccgtcattgagacattttctgtcaggcggttgctgtaaataagcttaacatcgtcgcccttccagacgcggatagtcggccccaggtaacgaccattgattccccaaaccgacgcgcgtgtccctggcgtaaatgaccagtgcgcacgttgtacagtcataaacagcggttgcccacggcgagattcaagcagcggcggaacgggtagcggttgctgttgcccggctgcgctggccttcaggggaacagcgcctgcacaaagtgcaatccccgatgcctgaatgaactgacgccgactgagtgacatatttgctccatgtaaaactggctaaagtaataccgtgcaggaaagtgttccccgcaaaaatacagattgccgacttaaacttttccggcggcttcgcgttctgcgacttctttatcgagctcggcgattttttgttccattatcgaacgacaatgggcagccaactcgcgaacctgatctttgccatactgactgacgtcaattggcggcagcatttcgacaatcaccagaccgttgtgtagccgattaagattaatcttattcgaagttgtagagacgcacacgggtataatcgggacgcccgccgcaattgccgcgtgaaatgccccggtcttgaacggcagcaggccgcgaccacggctgcgggttccttccgggaacatccagatggaaatacggcgttttttgaagtgattcactacttccgcaatagtgccgtgagctttagtgcgattgtttctgtcgatcaataagttgccggttaaccagtacaactgcccgaagaaggggatccacagcaagctctttttacctaccgtcactgtcggcggctgcacaatgttcgatgccgtcaccatgtcataattgttctggtggttagcaatatagatagcattgccgtagctttcagcgtctgcaggtttgcggcactccactttcaggccgaaaagcggcgcaagacggccaaacatatgcccaaaggtggccacatgtttcgggttacgcgggctgaaaaggcagtaaatggagccgaatacacagactaagatgctgtaaatcacggtaataataagacgaaagatatatagcataacaccctctgaaggtctgagagactggcattgtacgtcacctgaaaatcaggttagggcattgttaaaagccgctctctggaaaagcgtattgttaatcgcaacgcatgaataaacaacggtttcaagggaatttttatcgtttccgggggttgaatacgctgccggatgacgacttaacgtttcatccggcgttccttgcaagcgggaggaaacagcgccctccccggcatattactcttcgctatcaccgctgctggcacggcgaggagagtcgatctcaacacgatcgatacgctgcaaaccgcgcatcaacgtaccgcggcgtccacgttcgccagcgactttctgtagctcttccggacgcagtttaattttgcgtttcccaacatgaatggtcagcgtgctttgcggcggcagaacgtacagttgcgccaggccatcctcgccacgcgcggcttctgccgatggaatgttgataatcttgttgcctttgcccttcgacagctgcggcagatcgcttaccgggaacatcaacatacggcctgcctgagtgattgccagcagcatatcggaagcatcttcaatcaccaccggcggcataacatgggcattttccggtaaggtgatcaaagccttacctgcacggttacgcgccaccagatcgttaaaggtgcagacgaaaccgtaacccgcatcggaagccatcagcagtttctgatcgtcgctttccatcagcatatggtcaacggtcgctccaggcggcaacgttaatttgccggtgagcggctcgccctgaccacgcgccgacggcagcgtaatcgggtcgatggcatagctacgaccggtggaatcaacaaacactaccggttggttgctcttacctttcaccgccgctttgaagctatcgcccgctttataattcaggcccggcgcgtcgatatcatggcctttagcgctgcgtacccagcccatctgcgacagcacaatggtgacaggttcagacggcagcatgtcgtgctcgctcatcgctttcgcttcttcgcgttcctgcaacggcgaacgacgttcgtcaccgtaggcttgcgcgtctgcctgcagttctttcttcagcaggttattcattttacgctcggaagccaaaatgccctgcaactggtcgcgctctttttccagctcactctgctcaccgcgaatcttcatctcttccagtttggcaagatgacgcagtttcagttcgaggatcgcttccgcctgggtttccgtaaggccaaaccgcgacatcagcgccggtttcggttcatcttcattacgaatgatctcaatcacttcgtcgatattgagaaacgccaccagcaaaccttcgaggatatgcaggcgcttgaggactttctccagacgatagttcagtcggcggcgcacggtatcgcggcggaacaccagccattcggagaggatttccagcaggtttttcaccgccggacgaccatccagaccgatcatattgaggttaatgcgatagctcttttccagatcggtggtagcgaagaggtggttcatcacctgatccatatccacgcggttggagcgcggcacaatcaccagacgggtcgggttctcgtggtcagattcatcgcgcagatcgtcaaccatcggcagctttttgttgcgcatttgcgcagcaatttgctccagtacgcgcgcacctgaaacctgatgcggcaatgcgctgataaccaccgcgccatcttctttcttccaaaccgcgcgcatacgcactgaaccacgtccgttctcgtagattttacgaatctcggcgcgcgaagtgataatttccgcttcagtcggataatccggcccctgcacgatatccagcagctgatcgagcgtggttttcggctggtcgattaatgcgattgccgcctgagccacttcacgcaggttatgcggtggaatatcggtcgccatgccgacggcaataccggtggtgccgttaagcaaaatgtttggcagacgggcaggtagcattttcggctcctgcaaagtgccgtcgaagtttggcacccagtcagccgtcccctgccccagctcgctcaatagcagctcggaatatttcgacaaccgggattcggtgtaacgcattgccgcgaacgatttcggatcgtccggcgccccccagttcccctgaccatcaaccagcggataacggtaagagaacggctgcgccatcaggaccatcgcttcataacaggcactatcgccgtgcggatggtatttacccagtacgtcaccgacggtacgggccgattttttaaatttggcgctggcattcaggcccagttcagacatcgcatacacaatgcgccgctgaacgggtttcagaccatcaccaataaacggcaacgcacggtccatgatcacgtacatggagtagtttaagtaggcgttttccgtaaattcatgtagcgcaaggcgctctgccatatcgctcattaattctgattcctcaacttattcgccagccttcaaaggggcaatattgccggagatactacattatctgccgcgtcgagtcacaggagatcagcgtgaatagcgccgccggacgtgctccggcggcgataaaggcatcaatgtgccttgatatacaactctttgctgtagacataatcctggggattatgcagcggaaaaccgccaacgtagggtttaagcagtttgattaacggctgatagtagatgggaatcagcggtgcctgctggttgatgatcacttctgcctgctgatacaacgcattacgctttgtcgcatcagtgatctgcgtggcctggtttagtaaggcgtcatactgcgcatttttccagtgaccgacgttttcttcactatcgcttttgagcgtgttcaggaagctggaggcatcattgtacgtcgcatcccacgactgccgagacagcataaaatcaccggctcgtcgggcatcaagataggttttccactccattgtgcgcagcgtcacctgtgcacccagccattttttccattcggaagacaacgctatcgcggtcttttcatgcagatcgtacttgttgtagaacagctcaaagcgtagcggatgagaggcgtcgtatcccgcctgtttcagcaagacttttgccatcgcgacgcgctcactcattggcttttgcagttcatcgaacgtcgtcgcgctaaagccttttacctctggcggcgtcagcgtggttgcgggcgttctcaaccccagtaccttttgcgcaataagctgtcgatcaaccgtaagatatagcgcccgacgcacccgcacatcgttaaatggcggtttctcaaggttaaagttgtaatattcgctgttcagacgcgggataattcgtagctcgccaggctgtgatttttcaatggcgggaatttgctgcgccggaacccaggtgagatcgacctctcccgcgcgatagcggttatagccggtgaccgaattatccagcgccagatactcaacctgttgcaatactgtatgttgcgcatcgcggtactttggatttttgcgtgcagtaatcttttcgttaactacccatttatcaagcacaaaggcaccgttgtaaaccatgttctctggcttactccagctatcgccatgtttagcgatgacatgatgaggaaccgggaacagcgtcggccaggcgagcatcgtcgtgaaccaaggaactggctgctcaagcgtaacttcaagagtacgatcatccgtcgctttgacacccagcgatgtaacatctgctttacccgcaacaatagccgcggcattgttaatgtgcgcctgtgccagatagccagcaaaagggcttgccgttttcgggtcaaccgcgcgctgccagccgaggacaaaatcctctgccgtcagaggctgaccgtctgaccactgcaaaccgctacgcagatggaaaatatagcgcttgccgtcgtcaagtatctcccagcgttcagcctgagcgggctgcacctggccttcaccgtccatccataccagaccttcaaacagatccagcacaatctgcgcggcagtattctcctctaccttttgcgggtcgagcgtgcctgggtcgctatgattgttgtaacgaaagacttgttgcggggcgagcggtgtgttggcgggaacgtcagcagcgtagagaggagccgcacttaccaggctgaccagccataataaatttcgcgtatacatggtattccttaccggagaaattataagcccgacaacaatacgcctgtggcattgtttgctcaaacttatcgcgagtgatttggctcacactccggtaaagattccccatcacgccaacggcacataaatatccgtttccagtcgccgctctgtcatcccttcggcaagattggtgtagtgaaacaggatcggggctttgcgcattttttcgccgcttgcaggtagccagtggcgaatgatgccccatatcgtgtgtgaaatatcgtccagctcgccaacatggcgggcaacagcataacgcccaccggtaagttcgccattactcacgccataacgattatcggggatcggttcgctaacgctgccgcagatatcaaagcgaaacgcttccggtgcggtggtggcagggtcgtcccaggcgacgccaaaagtctggctttggttaacaggagaaagccccgtctctttacgccacatgataaatttcgccacgctatagttgagcaactcagggctacagcggtgcggcaacatcgccacagggattgatgggaaatcgataatatttacatccagtgtcaggtttgtcattttgcctccctgcgaaattattcccgggaacgcgtcccgggagcggtaacaattacggatttactttgcggatctgtttgacgtcaatttcaacagaattccagtctttatcgacttccccctgaatctcaaccgtatctttcggcgtcaccgtcacgccgttccagcgtttgtggtcgatatcaacattgatagtaccgctggcatctttgaacacgtagagatcgtcagagatgcgttcaacgatattgccgcgtagggttacccaggtgtcgtcacgcagggattttgcgctttctacggtcgttacgctgccgttcggcccctggaatcctccggcctgactttgcgttgccgatgggccagaaaaacctccctgctctgctgccataaccggtgcactgcacagggccattactgcgattactgctgcgaattttttcatgtttattactccctttaatgtctgtttccgagcatttaacaagatagtccttaacaacttcttaagggaaaaaaataaaatttaatgctgtacagagcgcgttacaacacggtttactggcagcaaatacggttatcgcagggatgaaaaaatgcgaattttactgatagaagatgacatgctgattggcgacggcatcaaaacgggccttagtaaaatgggttttagcgtcgactggtttacacaaggtcgtcagggaaaagaggcgctatatagcgcaccttatgatgcggtgatcctggatttaaccttaccgggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggcaacgtcatgctcgaccccggcaaacgtatcgccacgctggctggcgaacccttaacgctgaaaccaaaagaatttgccctgctggaattactgatgcgtaacgctggtcgggtactgccgcgcaaactgattgaagagaaactgtatacctgggacgaagaggtcaccagtaatgccgttgaagtgcatgtgcatcatctgcgacgcaaactcggcagtgattttattcgtaccgtgcatggtattggctacacattaggtgagaaatgaaatttacccaacgtcttagtctgcgagtcaggctgacgctaatctttttaattctggcctcggtgacctggctgctttccagctttgtcgcctggaaacaaacaacggataacgtcgatgagttgttcgacacccaactgatgctgtttgccaaacggttaagtacgctcgatctcaacgaaatcaacgcggcggatcgcatggcacagacgccaaataaattaaaacacggtcatgttgatgacgatgcgctgacttttgccatctttacccacgacggcagaatggtccttaacgatggcgataacggagaagatattccctatagctatcagcgggaaggttttgctgacgggcaactggtcggtgaagacgatccctggcgttttgtctggatgacctcacctgatggcaaatatcgcatcgttgtgggtcaggaatgggaataccgtgaagacatggcgctggcgattgttgccggacaattgatcccgtggctggtcgcactgccgattatgttaatcatcatgatggtactactgggtcgtgaactcgcgccgctgaacaaattggcgctggcactacgtatgcgtgacccagactcggaaaaaccactaaacgcgacgggcgtacccagcgaagtgcgcccactggttgagtcgctaaatcaactgttcgcccgcacacatgcgatgatggttcgtgaacgacgctttacctccgacgcagctcacgaacttcgtagcccgttaacggcgctgaaagtgcaaaccgaagttgctcagctctctgacgatgatccgcaggcgcggaaaaaagcgctgctccaattacattccgggatcgatcgcgctactcgtctggttgatcaactgctcacgctatcgcggctggactcactggataaccttcaggacgtcgcggagatcccgcttgaagatctcctgcaatcgtcggtgatggatatttaccacacggcgcagcaggcgaacattgacgtgcgactgacactcaatgccaacggcatcaaacgcaccggacaaccgctattgctaagtttgttggtgcgaaatttgctggataacgccgtgcgttacagtccacaaggtagcgtggtagacgtcacgctgaatgccgataatttcatcgtgagggataacggccccggtgtgacgccagaggcactggcgcgaattggcgaacgcttctatcgcccacccggacaaaccgctaccggcagtggacttgggctatcgattgtccagcgaatcgccaagctgcatgacatgaatgttgaatttgggaatgcggaacaaggtggatttgaggcgaaggtaagctggtaacttctctgtctatgagagccgttaaaacgactctcatagactttactaatagcaaaatataaaccgtccccaaaaaagccaccaaccacaacccagacaaataacgagcgagaatacatatagccaaaactcgaacatttcccgcataaagagttttcttaagataagaataataagtggtgtcagaagaaaaaatgctgcaatcattgcttacaatatacgatcttcgcctgaaacagaaggtatactgcaaatattgtctcccgactcaagcatccagtcatacttattgaaagcaaaaaaagaatctattaaccaataagtaagcattatatataatagtgcttcaaatattgatagtagttgtttttttaacatatctgattactcattaatcaattttttgatatgttctctaatctctaacaacctcataccataagagatgaatttataatcatctgtatcacgcgcaggcaaattattaattaaacaaataaaaaaacccaaatctcgttcaacaccacgattatatctaataccagccataatatactgctcattcgtcatatacagtgttgccgaagagggataatcaaaaagaacaagatctcttaaataagtagcagcaatttgaaaggtaaaatcatcctccattaggcatgtcgctaactctaactgatttctggtagttaattctgaagggtctagacctagagtaatcgctgcggttcgtatttgtatacccattgagccaaatgatgttttattttcaggcatatctaacaatccgatcattctttttgtttcatatatctgaaacttataattttcaggcatacctcctgactcaatccaggccacgccgcccagtaactctggacgaattccagcggcgtatgcatgtttaattattttgtctctattatattgtacatatgcatctttataagcatttaaataatatactcctgaacggcgacgcgaatcattttttcctaacttccagagtaaaacgtccatttcatcccatttacggaacttcgcttgtggaattgtacaatatctattttttatagtgagatcgcttttcatatttaaaaaatcctttcttcccaacaactatatgattccgtactcgcgatatggtgcttccatgttatatttttataattaagaacaatgacatcttccggctgattacccgcatgtgtaattgagtgtggataacatgtcagaatattcgataaatgtgctccttgcaattcaattgtgtaaaacctttcaatacaaccgccagaattaattctataaaaattaaatacagctgataactcttcattttcagaaagagcggcatttaataaaggggaggatttatctattggcttgtaaaattttatggggtgatgcactacattatactctcgacttaaagaatggtcgaactgtaaaacaaaaatttcatccacatgatttatttgatatttattaccaatagatgcatacgaaccacaaccctcagagatcaaaccttgtattttccctttaattgataagtatatcatatttgacatatatattctccataatcattttttccgaaaaactcctgtatcatttgcataatacatctctcctgtgggagcttatgggaagttgatttaagtattgtcattttcagaaaatatttatcccgcatcggtgaatcagagaaagatcagacttttgctaaattcgcaaaagactttgcacattttgctaatttcaccgtaccgctctgtgacgtactatagtcggcaaacgtctcaccttgaggttaaaaaatgagcaacatcctgattatcaacggcgcgaaaaaattcgcccactccaatggtcaactgaacgacaccctgaccgaagtcgcggatggcacactgcgcgacctcgggcatgatgtccgcattgttcgcgccgacagcgactacgatgtcaaagcggaagtacaaaactttctctgggctgatgtggtgatctggcagatgccaggctggtggatgggcgcgccgtggacagtgaaaaaatatattgatgatgtattcaccgaaggtcacgggactctgtatgccagcgatggtcgtacccgcaaagatccatcaaaaaaatacggttccggcggcctggtacagggcaaaaaatnnnnncattccattcattaattaattaatgaatgaatgnnnnntgccacggctatgcgccaatggtggattgcgctgctggcgtgagtttccagtctatggcaccggattctatcgtaatgattgagcagtgggaaagcatcgcgcatcttgaagcgcatctgcaaaccccgcacatgaaagcatatagcgaagccgtaaaaggtgacgtgctggagatgaatattcgtatcctgcagccggggctttgacatttctaaaaagaggccggtgctgctaccggtctcagcccagattagccattctttcttcccgttttcagtcctcgatggaaatcgttaattcgcttaatggttttaaccgcacgctgcggcactgcggaagctaccgaccagacaatcatttccagacacaacaataccgtaccatgtagcggcgttttccctttttcatccccgcgcggaacatgaatcacgatactggcgtctttgctaaaacgtgaatccagcgcgtttgtcagcaaaataacagggatccccagccgcctcgcctcacgaagcgttgtcagcccttcccggtgcgcagatttttgcgccatcatgatcagaacatcgccacgttgaagcgcgatcagttgctcggcaaggccaatacccgtacggtttagtgccgtggcaggcaaacctatgcggttgaatagtcgtgcggtatagtccgccagaatacccgaagcgccaatgccaaaaattgcgacttgccgtgcctgcaccaacaacgctacagcttgcgcaagcgcgtggcggttttcaggctctgacaggacattacaggtatacaaatgcccttcaagaacaaagtcgattgcggtgttaacatcgctcgtcaagttactcaccgtcgtagacatcttttcgctggaactaagggctggaccaagccactgttccagagtgcgtttcagatcacgcagcccggcaaaccccagggcctgtatagccctgataactgtggcatcggaagtgttcaacgtggccgcaatttccatcgccgtttgctcgagtaccacttcacgatgctcattaatgtagctggcgacagctcttaacccaggcgttaactgactcgcgcgagtgcgaaaacgctcaccaaaaatatcaacccgcgctttatctttctggatcatttagcctccggtagaggtcgccctgcaatttgtgattgtatctgcgcagccatcagccccagagatgcaaaggagttagaaattgcctcttcacgagaaatcagcacataacgcccggaacgacaggcagtcagaaactgacaccatcccggcatgactttttccattgctgccagctcatcctgaggtttaccaccggtgtcaccgcgccaggttgcaaaaacaaaatcggcatccagttcaggtaaacgctccgcgctcacatccattcgcccaccttcaggaatgctctcaatcagcggcggaaaacgaaaaccagcatcgcgtaatacccgccccagcgaatgatagctatgcatcacattaatttttccctggtttgcctgaatcaccgataccgttattttttggctgtccagcgtcgccttcagcgcattgatttgtgcctgatagcggcgttcaagtatcgccagctgcgactgcgttcctgtaagttctgccagcttgcgatagatttctggcgcaccccctttgagatgatcaatgctcaccgtgggcgcaattttttcaagttgttcaatgggcgtattacgggtcggttctgtgatgatcaggtcaggctttgccgccacaatcgcttcaatatcaatatcagcggtaccaataaaggcgatcgatgaattatcaaagtcgacacctgtcaataacgcgccagatcgaatgaaatggctaccgtcaggccgagttcgcccgtggctggcgacaggaggtacaccgagctcaatcagaggaatagtgatatcaagatcgtgtaaagagacaattctctttggatgagcaggaacagtgactttgcgccctaaatcatcagtaaatacctgaacaggttctgttgcacgggaaaaaaatgacaacagtatcagcagagaaaaaaataaacgcatataactcccgttaaaaactgttcctgcgctgccagagcagtagcaaaaaaaatggtccaccaatcagtgagataatgattccggcaggcagttgcaaaggcaaaaaagccaaacgaccaatgctatccgccagaataactaacaacgcccccgataccgcgctccccagcagtaatgtcgtctgcccgccacgtagaataaaacgtgatatatggggtgctatcaatccgacaaaaccgatgttaccaacacacgaaacgcagacggctgtcaggattatgggtgcggcgacacgtaacaacgccagacgagaactattcacccctaacccggttgcaacctgatgaccaagcagagcgatatccgcagtcctggcggtgaacagcaataaaagagcggctggcaacatccaacaggctgaaataccgactaacatccagttagctgcatgcaggcttcccgataaccacatcaatgcagtttgtacatctcgaacatctgcagtggtcataaatacaccgataccggcggcgaaaaaccaggaaacaccaataccaatcagaacaaatcgcgggcgggaaatatcgcgcgcacaaaaaatcacgattaaagccaccaacagaccaccagcaagaccagccactggacgccagaacattcccagcattggaaactggaaaatcagccacagcaccgccacgctacatccttctttgacgccgattaaaccaggatcggcaaggccgttacgcgcaatggattgcatcgcggcccccgccatacctaacatggccccgcatagcaatgccatgatgactctcggcaagcgaatatcctgcacaatataacgtgcgtctgtgcttacgttttctggagcaaacaacgctcgtcctacttccgatgccggaacagagaaagaaccctgcatcagaccgaatatcagtattccaaccgcaagcaggaacagcccaccaagcaacagcagatttttagggcgcaccagtgtcgaaaacttaccaacacgtagtgggcgtagcccgacgttcattatccgactcatttgaacatcctcgtcgccataatgacaaaaacaggcgcaccaactaacgccgtcatgacaccggtcgctaactcatggggcgtgaaaagcgtccgggcaataatatctgccagtaataacaaaagcgcgccgacacaagctgaaagagggagcagaacgcgcagatccgctgataccagacgccggacaatctgcggtactagcaggccgacaaaaccaatggggccagcaatcgatacggctgcgccacagagcaacgcgatcgcaagcagggtgaatgttcgcgtgcggagtacagagacgcccagcccctgcgccatgcgatcgcccagtgccaacatgttaagggagggtgcaaggtaaagggctaacacaaatccccccagagaaaaccaggcggacgtacccagcgtcgcccaatcctgccccgctaaatcacctgctagccatgtccgcatcgccagcagtgtttgttcgtcaagaatcaggattgcagccgttattgaggacacgaacgccgatagcgccacgccgcataaagtaactttcattggcgttaaccctgaacgccctgcggaggaaagcagcaatatcaacaggaacaataacgcgccccccgtagatgccagcagtgggcgtccaaccggaaaggccagtccaagcgcactagcggcaacgacagcaagagcggctccggcatttaagcctaaaatatgtggctcccccaatgggttacgaatgacagcctgcaacaaagcaccagcaacaccaagagaagcaccggtaagcaatgctgccgctaaacgcggcaaacggagtcttacaattacgttgtgatcgaagttttgcggatcaaaatgaagaaatgcctgcaacaccgtttgtggtgcaataaatcgggcaccaatccctggatataccacgcatcccaccagcagtaaggcgaggaaaattacagtaaccagccctgtgcgcatcatactttttctacaccacgaaacggcatgaagtacggctttcccgtcagaggatttattgatgcgtgaacatcaacgtcaaagaccgcttttaccagctcaggcgtgcaatgctccccctcattcaacacacgcaccactttcccctggcgtaaaaatatcaacgtatcaccataattgacggcaaaattcagatcatgcaacaccacgacgactgtacgcccgtgatgacgcgttaaatcatgtaataactcaagaatttcaacctgataacgtaaatcaagccaggttgtgggttcatccagcaggatataaggcgtcttttgcgccaacaccatcgcaatccagcaacgctggcgctgcccaccagagagtttttcaacaggtaaatgtgcaaactcctgcgtacccgttaatttcagggcctcttccaccgccagctcatcggcgtcgctccattgacgtatgaaattttgccagggaaaacgcccacgcgataccagttcataaacggttaagccctccggcaataatggcgactgcggcaagatcccaagtctacgggataacgctttcgttggttgctcgtgaatcgctttgccatcaagcaatatcgaaccgcccatgggttgcaagatacgtgcaatggtgctgagcaacgtcgactttccacagccgtttgccccaaccagaacggtcattttttctgtgggaacggagaaagaaacaccatcaacaatgatcttcttgtgatacccggcagaaacattgtcgaggatcagcccctgcccttttgcgttatgtgccacgtgtacgccaacttaatcaaagacaaacaaaaataaaactcattctcctttgagagtttgacgccacaaaatgtagtagtcaagcagttaaaagccacacaaaaacaaggtaaataacaggtaaactatttttatacataaaaataaaaacattaaatatcaataaattaaaagcaatcaaattgtataaacttttcataaaaacacatgtagcaattttttgttatttctcatttactactacattactgcgtgattgaatgattctcaattacatatccgatggcgaaataacaaacggatagtgcttagtgagcaataagaaacaattttcactcgcgacaatccgcgagtttttgggataacagactaaatggctatgttcacaccttcattctcaggactcaaaggtcgggcgctcttttcactgctttttgcggcaccgatgattcatgcaacagactctgtaacgaccaaagatggcgaaacaatcactgttacagcagatgcaaataccgcaactgaggcaaccgatggttatcaacctctgagcacctccacggcgacattaaccgatatgccgatgctggatatcccgcaggtggtcaatacggttagcgatcaggttctggaaaaccagaatgcgacaacgctggatgaggcgctttataacgtcagtaacgtggtacagaccaatacattaggcgggactcaggatgcttttgtacgccgtgggtttggcgcaaaccgggatggctccatcatgaccaacggtctgcgaaccgtacttcctcgtagtttcaacgccgcaacagagcgtgtggaagtgctaaaaggcccggcctccacgctgtatggcattctcgatcctggcggactgattaacgtcgtgaccaagcgcccggaaaaaacattccatggttcggtttcagccacctcctccagttttggtggcggcactgggcaacttgatatcacaggtcccattgaaggcactcagctggcgtatcgccttaccggggaagtgcaggatgaagattactggcgaaacttcggtaaagagcgcagtacatttattgccccgtcactcacctggtttggtgataatgcaacagtaaccatgctctattcccatcgggactataaaactccattcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatatacaaccctgtttatggtaataccagcaaatgtacaacggtttcggcgtcggacagcgatcagacgatcaaacaggagaactactcagcttatgcacaggacgcgctctatctgaccgataactggattgccgtcgccgggatccgctatcagtattacacgcaatatgcgggtaaaggccgtccttttaatgtcaatactgacagccgcgatgaacaatggacgcccaaactggggttagtctacaaactgacgccatcggtatccttatttgccaattattcgcaaacatttatgccgcagtcgtcaattgccagctacattggcgatcttccaccagaatcatctaatgcttacgaagtcggggcaaaattcgagctattcgatggtatcaccgcagatattgcgctgtttgatatccataaacgtaatgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgcaaaggttctggaagatcctgattatgcagggaaaccattgccgaatgttcctcgtcataccggttcgctattcctgacctatgatattcataacatgccaggcaataacacactgacgtttggcggtggcggacatggtgtaagccgtcgttcggcaaccaatggggctgactattatctgcctggctatttcgttgccgatgccttcgccgcatacaaaatgaaattgcagtatccggtcactctgcaattaaacgtcaaaaacctgtttgataaaacgtattacacctcttccatcgccacaaataatctgggcaaccagattggcgatccgcgtgaagtgcaattcacggtgaaaatggaattttgatcaaaaaagcccggtatacacttgtataccgggctatgttttattcttctggcgggaggattatcagacctcaatctctgccatgtcgcctttttcttgcaaccaattgcggcgatcttccgagcgtttcttcgccagcagcatatccatcatcgcgtcagtacgctgatcgtcttcatcatcgatagtcaactgcaccagacggcgagtgttcggatcaagcgtggtttcgcgcaattgcatcgggttcatttccccgagacctttaaaacgctggacgtttggcttgcctttcttgcgttttaattgctcaagtacgccctctttctcttcttccgtcagcgcgtaataaacctctttcccgaggtcaatacggtagagcggtggcagtgcaacgtaaacgtgaccgtgtttcaccaatgcgcggaagtgttttacaaacaaagcgcagagcagcgtggcaatgtgcagaccatcggagtcagcatccgccaggatacagatcttgccgtaacgaagctggctcaaatcgtcgctgtcaggatcgataccgatagctaccgaaatatcgtgcacttcctgcgaagccagcacttcgtcggaagagacttcccaggtgttaaggatcttacctttcagtggcatgatcgcctgatattcgcgatcgcgcgcctgcttggcagatccgcctgcggagtcaccttccacaaggaatagttcggtacggttaagatcctgcgcggtacagtcagccaatttaccaggcagcgccgggccgctggttagctttttacgcaccacttttttagccgcacgcatacgacgctgggcgctggaaatcgccatctctgccaacagctccgccgcctgaacgttctggttcagccacaggatgaaggcatctttcaccacgcccgaaacgaatgccgcacactgacgcgaagagagacgttctttggtctgcccggcaaactgcggatcctgcatttttactgacagcacataggcgcagcgatcccagatatcttccgccgacagctttacaccacgcggcagaatgttgcggtattcacagaactcacgcatcgcgtccagcaggccctgacgcaggccattaacatgggtaccgccctgcatcgttgggatcaggttgacgtagctttcggtcagcagttcaccgccttccggcagccacagtagcgcccagtccaccgcttcagtatcgccagcgaaattaccgataaacggtttttctggcagcgtcggtaaaccgtttaccgcttccgccaggtaatcattcagaccgtcctgatagcaccagcgctgttcggtgttgttgatctcatctttaaaagtgatctcaacgcccgggcacagtaccgctttggctttcagcacatgcgtcaggcgtgaaacagaaaaacgcgggctgtcaaagaaggtttcatccggccagaagtgcacgctggtaccggtattgcgtttaccgcaagtgccgacaacctgtaaatcttgcaccttttcgccattttcaaaggcgatgttatagatctgaccatcgcggcgtacgttaacttctacgcgcttcgacagggcgttaactaccgaaatccccacgccatgcaggccgccagagaactggtaatttttgttagagaatttaccgcccgcgtgcagacggcaaagaatcagttcaaccgccggtaccccctcttccgggtgaatatctaccggcatcccgcgcccatcgtcaatcacttctaacgactggtcggcatgtaagattacatccacgcgttttgcgtggcccgccagtgcttcatcgacactgttatcaataacttcttgccccaaatggttagggcgagtggtatcggtatacatccccggacggcggcgaaccggctcaagcccggtgagtacctcaatggcatcagcgttataagtttgcgtcatggtttaagttagcaattcgagttgatcgtcagagatggtgcagaccaagaaaatcgacgatcgggttgaaataatcttcgaagcccgtgaatgcgtggttgccgccttctatgacagtctggcggcaggaagcgtagtacgccaccgcctggcggtaatccagcacttcatctcccgtctgttgcagcagccagatcaaatccggcgcttccagcgggtcaatctgcatgactttgagatcgtaaatatggcgtgactctagcacatattgctgcccggtgtaggggttctcgttctgaccgagatagtccgtcagcagttcaaacgggcgcaccgccgggttgaccaccactgcgggcagcataaaacattgcgacaaccaggtggcgtaatatccccccagtgacgaaccgacaatacccagcgaatcgccgccatgttccaggacaatagattccagcagttctgccgcgtcagaaggatacgggggcaactgcggaatgatcatctcaacgtcagggtgatgttccgccagccagttttttaacaagctcgcttttgcagagcgcggcgagctgttgaaaccgtgtaaataaagaagcgtagacatcagtagccttctgaagcggtatcaggttggaagcgtgcgtccgccaggcgatgcacctcggtggtcagcgtgccatcagcatgtaactcgagagtacgccagccgggcgcgatggtgtccagcgtaaagttagaacaatgcggcttaaactgcacacaggtcgacggcgttgccagcaagcggcgaccgttccagtcgagatccagctcctgatgaatgtgaccgcacagcaagtatttgacgtgcggaaacttcgccagcacggtatccagttcgcccgcgttacgcaggctgtgttgatcaagccaactacaacctgcaggtagcggatgatgatgcagcagcagcaacgtatggcgttctggcgcatcggccagtttacgttccagccactcaagctgaaactcgctcagctcaccgtgcggcacgccaaacacctggctatccagcaacaggatttgccattgctcaccaataaacacgcgcttcgccggggagatacccgcatcctgtaacgcactgtacatcgcgggctggaaatcgtggttgcccggcagccagacgcagggcgcacgaaaacttgcgatgccttcagcgaaatgctgataggccgcagaggattgatcctgcgctaaatcacctgtcgcgacaatcaggtcgaattcgtgctggtgtggccgaatcgcctccagcaccgcctggtagctttcccaggtgtttacccctaacagggcttcgtgcttttgtgcaaacaggtgagtgtcggtaatttgtaaaatcctgactctggcctcaccagccagaggaagggttaacaggctttccaaatggtgtccttaggtttcacgacgctaataaaccggaatcgccatcgctccatgtgctaaacagtatcgcaaccagtccgctaaaaactgattaatttgatgcttttcgtcgcgttgatgcaactttttattaggataatcataccgcgctttgaagcgaaaaatctgctggcttgaacacacttcagccaccatcgcgtcatgatacagacgcaccgtcattgacggaaggctccagtaactgatcgcgggcgcagtctgttctattgtcaccagggtagtgtatcgggtcgattccacaatcgtcagccgatattgtgcgtttgccacctgatagcttacagtttcgccgggtgcgtcattgcgcggtaacaaacggcgcaattgtgaaaagttcatctcgcacaggcgcatcatttcaggaaagtcaggtgtgtaacgcttcatttatgcccactcattttttaacgcttgatgatgcagctgcagccattgcaaagcgatgaccgacgctgcgttgtcgattttcccctcttctacccactggtatgcctgttcccggcttaccacatgaacgcgaatatcttcgttttcatcagccagaccgtgaataccgcttgcggtcgtggcgtccacttcgcccaccataattgacgaacgctcactggtgccccccgggcttgccaggaaacttaacaccggtttggtccgtttgactatcagtcccgcctcttcaatcgcttcgcgacgggcaacatcttccacactttccccctcttcaatcatcccggcaaccatctccagtagccagggggtttcgctggtgtcgtacgcggcaatccgaatctgctcaatcagcacaacttcatcacgtactgggtcaaagggtagcaagactgcggcgtgaccgcgctcaaaaatttcccgccgtacctcatgactcatttgcccgttgaatagacgatgacgaaatctataaagatctaatgaaaaaaagccgcgataaagtgtttctcgtgcaataatttctacatcgtttttgccaaatgtaacgggcaggttgtctggcttaagcattgttaatgtcctggcactaatagtgaattaaatgtgaatttcagcgacgtttgactgccgtttgagcagtcatgtgttaaattgaggcacattaacgccctatggcacgtaacgccaaccttttgcggtagcggcttctgctagaatccgcaataattttacagtttgatcgcgctaaatactgcttcaccacaaggaatgcaaatgaagaaattgctccccattcttatcggcctgagcctctctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacaactaggtttaggtgcagattacacctatagcaacggctaccgcgacgcgaacggcatcaactctaacgcgaccagtgcgtccctgcagttaactcaatccatttttgatatgtcgaaatggcgtgcgttaacgctgcaggaaaaagcagctgggattcaggacgtcacgtatcagaccgatcaacaaaccttgatcctcaacaccgcgaccgcttatttcaacgtgttgaatgcgattgacgttctttcctatacacaggcgcaaaaagaagcgatctaccgtcaattagatcaaaccacccaacgttttaacgtgggcctggtagcgatcaccgacgtgcagaacgcccgcgcacagtacgataccgtgctggcgaacgaagtgaccgcacgtaataaccttgataacgcggtagagcagctgcgccagatcaccggtaactactatccggaactggcggcgctgaatgtcgaaaactttaaaaccgacaaaccacagccggttaacacgctgctgaaagaagccgaaaaacgtaacctgtcgttgttacaggcgcgcttgagccaggacctggcgcgcgagcaaattcgccaggcgcaggacggtcacttaccgactctggatttgacggcctctaccggaatttctgacacctcttacagcggttcaaaaacccgtggtgccgctggtacccagtatgacgatagcaatatgggccagaacaaagttggcctgagcttctcgctgccgatttatcagggcggaatggttaactcgcaggtgaaacaggcccagtacaactttgttggtgccagcgagcaactggaaagcgcgcatcgtagcgtcgtgcaaaccgtacgttcctccttcaacaacattaatgcttctatcagtagcattaacgcctacaaacaagccgtagtttccgctcaaagctcattagacgcgatggaagcgggttactcggttggtacgcgtaccattgttgatgtgttggatgcgaccaccacgctgtacaacgctaagcaagagctggcaaatgcgcgttataactacctgattaaccagttgaatattaagtcagctctgggtacgttgaacgagcaggatctgctggcactgaacaatgcgctgagcaaaccggtttccactaatccggaaaacgttgccccgcaaacgccggaacagaatgctattgctgatggttatgcgcctgatagcccggcacccgtcgttcagcaaacatccgcacgcactaccaccagtaacggtcataaccctttccgtaactgacgacgacgacggggcttcggccccgtctgaacgtaaggcaacgtaaagatacgggttatctgccgcattcttcccccttctcgcttcaatttcgaccagccatcctctattctgatgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgccagcaggcaccagcccaggcaggcatggcaccagaaaaccaggcgcaggcccagcaatccagcgggagtttctggatgccgctgatggccggttacatgatgggacgtctgatgggcggcggcgcgggatttgcacagcagccgctgttctcctcgaaaaacccggccagcccggcttacggtaaatataccgacgcgaccggtaaaaactatggcgcagcccagccaggccgcaccatgaccgtaccgaagacggcaatggcaccaaaaccggcgaccactactactgttacccgtggcggttttggtgaatctgttgccaaacaaagcactatgcagcgtagcacaaccggcacctcttctcgttcaatgggtggctgataccgatggaaagagtcagtattaccgagcgcccggactggcgcgaaaaagcccacgaatacggtttcaattttcacaccatgtacggcgagccgtactggtgtgaagatgcttactacaagttgaccctcgcccaggttgaaaagctggaagaagtcaccgccgaactgcaccagatgtgcctgaaagtggtggaaaaagtgatcgccagcgatgagctgatgaccaaattccgcattccaaaacacacctggagttttgtgcgccagtcatggctgacgcaccagccatcgctttattcgcgtcttgatctggcgtgggatggcactggcgaacctaaacttctggaaaataacgccgatacgccaacgtcactatacgaggcggcgttctttcagtggatctggctggaagatcagcttaacgccggtaacttgccggagggcagcgaccagtttaacagtttgcaagaaaagctgatcgatcgcttcgttgagctgcgtgaacagtatggcttccagttgctgcatctcacctgctgtcgcgacacggtggaagatcgcggaaccattcagtatttgcaggactgcgcgacggaagctgaaatcgctaccgagttcctctacatcgacgatatcgggttaggtgaaaaaggtcagttcacggatttacaggatcaggtgatttccaacctgttcaagctgtatccgtgggaatttatgttgcgtgagatgttctccaccaagctggaggatgcaggcgtacgctggctggaaccggcgtggaagagcattatctccaacaaagcgcttctaccgctactgtgggagatgttcccgaatcacccgaacctgctgcccgcttattttgcggaagatgatcatccgcaaatggaaaaatatgtggttaaaccgatcttctcccgtgaaggcgcaaacgtgtcgatcattgagaacggcaaaaccattgcagcagcggaaggtccgtatggcgaagaagggatgattgttcagcaattccacccgttaccgaaattcggcgacagctatatgctgattggtagctggctggtgaacgatcaacctgccggaattggcattcgtgaagaccgtgcattgatcacccaggatatgtctcggttttatccgcatatttttgttgagtaatacagcttaatattgccccgataagcggggcaatctcttataatccaccattcataactcccatcaatatataaacacatacatatccaacctttatttaacattaatactcaatttaatgttaaatcgtcatatgcaagcgatattgtaattaaagtaagtgaatacatcacaacataactatttgatattatttaaatactttacttttatctcaccagatttaaatttaataattaaaaaacaatgttgcagggatcacactacacagtattgaacattgtgattgatatattgcccccctactatccattaaacataaatatttgtttcaccgaataacaacatatttaaaagaaacacaaaagcattctcactctttattgaattaatatttatattcacgtaacgaatttattagcaccctctcaacagtcgatattcatcattattatatatttgcgttatataaggagatatatccatgtttgataaatatagaaaaacactcgtagccggaactgtggcgataaccctgggtttgtcagcatcgggggtgatggctgcgggttttaaaccagcgccacctgccgggcaactgggtgcggtcattgtcgatccctacggcaatgcaccactgaccgctttggttgacttagatagccatgttatttctgacgtcaaagttaccgtccatgggaagggcgaaaaaggcgtagaaatcagctatcccgtgggtcaggaatcactaaaaacttacgatggtgtaccgatttttggtctttatcagaaatttgctaacaaagtgaccgttgagtggaaagaaaacggcaaggtcatgaaagatgattatgtggtgcacacttcggccatcgtcaataattacatggataaccgctctatctccgatttacaacagaccaaagttattaaagtcgcaccgggttttgaagatcgcctctatctggttaatacccacacctttaccgcccaaggttccgatctccactggcatggtgagaaagataaaaatgccggtatccttgatgcgggtccggcaaccggcgcactcccttttgatatcgcgccctttactttcatcgtcgataccgaaggtgaataccgctggtggctggatcaagacactttctacgatggtcgtgaccgcgatatcaacaagcgtggttatctgatgggtatccgcgaaacgccacgcggcacctttaccgctgtacaaggtcagcactggtacgagttcgacatgatggggcaggtgctcgaagatcacaaactaccgcgcggatttgctgacgccactcatgagtccattgagacgccaaatggcacggtactgttgcgcgtaggtaagagtaactatcgtcgcgatgacggcgtacacgtcaccaccattcgtgaccatatcctcgaagtcgataaatctggtcgcgttgtcgatgtatgggatctgaccaagatcctcgatccgaaacgcgatgcactgctcggcgcgctggatgcaggtgcagtttgcgttaacgttgaccttgcccatgcaggacaacaggcaaaactggaaccagatacaccgttcggcgacgcgctgggtgtagggccaggccgcaactgggcgcacgtgaactctatcgcctatgacgcaaaagatgactctatcatcctctcctctcgccaccagggtgttgtgaagattggtcgtgataagcaagtgaaatggatccttgcgccctctaaaggttgggaaaaaccgctggccagcaagctgctgaaaccggttgatgctaacggtaagccaattacctgtaacgaaaatggcctgtgcgaaaactcagacttcgactttacctacacccagcataccgcctggatttccagcaaaggaacgctcaccatttttgataatggcgatgggcgtcatctggaacaacctgccttaccaaccatgaaatactctcgctttgtggaatataagattgatgagaagaaaggcaccgttcagcaagtgtgggaatacggtaaagaacgtggctacgatttctatagcccgattacctccatcattgaatatcaagccgaccgtaacaccatgtttggcttcggtggttctattcatttgttcgatgtcgggcagccaaccgtcggtaagttgaacgaaatcgattacaaaaccaaagaagtgaaagtggaaatcgacgtgctgtcagataaacccaatcagactcactaccgtgcgctgttagtccgtccacaacagatgttcaaataattaagaagggaataaaaatgtcgaaattagggatctcatcactatttaaaaccatactgcttaccgcagctctggcggtttcatttaccgcttctgcatttaccgaaggcacggattacatggttctggaaaaaccaattccgaatgccgacaaaacgctgattaaggtatttagctacgcctgcccgttctgttacaagtacgacaaagcggttaccggtccggtatcggaaaaagtgaaagatatcgttgctttcacgccattccatctggaaacaaaaggtgaatacggcaaacaagcaagcgaagtctttgcggtcttgatcaataaagataaagcagcaggcatttccttatttgatgctaactctcagtttaagaaagccaagtttgcctactacgcggcttatcacgacaaaaaagaacgctggtctgacggtaaagatccggctgcttttatcaaaaccggtctggatgccgcaggtatgagtcaggcggattttgaagcggcactgaaagaaccagcggttcaagaaacactgaaaaaatggaaagcctcttatgatgtcgccaaaatccagggagttccagcctatgtcgttaatggtaagtacttgatctacaccaagagcatcaaatccatcgacgcgatggcagaccttatccgtgagttagcaagcaaataacagggaaacaggctatgggtattaagggaatgtggaaagatcttcgcacatcaccagttgacacactggtcagatggcaggagcaacgcttgttgtggttgttaatggccgttgcgatgggcgcgttaattatcctggcgcactctttcttccagatctatctctacatggcaccctgtgagcaatgtgtatacattcgctacgccatgtttgtgatggttattggaggattggttgcagcgatcaacccaaagaacatcatcctaaagctaattggctgcgtgatggcattttacggcagcattttgggactgaagttttcgctcaaactgaacgatatccaccatgcagtacataatccggatcccgattcactgtttggcgtacagggttgctctaccgatcccacttttccctttaacctgccgctggcacagtgggcaccaaattggttcaagcctaccggggattgtggctatgacgcaccaatcgttcctgatggcgtcacactgagcagcacgcaacagtggtttgtggaaatgtatcagcaatctgaaggctggtatctgctaccaccatggcattttatgaatatggctcaggcttgtatgctggcttttggtatgtgtctggtgctgctggtcattatgagtggcgcatgggcgcttaaaatcatcagaggctaactcagcaacacccgaagccagtcgttctggcttcgggttcttttattaacctatctgcaccgacagcatacttaaactgcccatttctataccatcgaccggaatggtaattggctcctgcccatcccacgcccctaagacatacaacaacggcagatagtgctctggcgttgggttcgataacgcgccaccttcatggtcgagataattcaccagaggatgttgttccactggcccttgccacgtcagattcgctttcacatactcattaaacgacgtcgcccacggatacggtgaactatcaccgtgccacttcactgtacgcaggttatgcaccacgttgccactggcgaccaacattatcccttcatcacgcagcgccgcgagtttgcgccccatttcgaaatgccaggcggcaggtttgctactgtcgatactcaactgcaccatcgggatatcggcgtcagggtacatcttaatcagcactccccaggaaccgtggtcaaagccccaggcttctttatccagcgccacaggaaccggcgctaacagctcaaccagacgctgtgccagcgcaggcgaacccggagcaggataatgcgtatcgtacagtgcctgcgggaagccaccaaaatcatgaatcgtgggcggcgtctccatcgcggtcactcctgttccccgggtaaaccagtgagccgaaaccaccacaatcgctttcgggcgtggcaatgtcattcccaacgtctgccagctgcgggtatacaaattatcttccagcacgttcatcggactaccgtgacctaaaaacaatgctggcatacgtgttgaagacatgatgatatccttaactaaaggtgtcattttgatatcctcacaatacgcttgttcggcggagtaagaacccggataacaatgatgatgatcatcagttattttgacgatctgcctgaaggtgaagatttataaggagttgtcgatgtcagtacctctcattctgaccatactggcgggggcagccacgtttattggcgcgtttctcggcgttctcgggcaaaaaccctcgaaccgcttactggcgttttcgctaggatttgcggcggggatcatgttgctcatctcattaatggaaatgcttcctgccgcattagccgccgaaggaatgtcgcctgtgttgggttatggaatgtttatcttcggtctgcttggctattttggcctggaccgcatgttgccacatgcgcatccgcaggatttaatgcaaaaatcggtgcagccgttgccaaaatcgatcaagcgcacagccattctgctcactctcggcatcagtctgcataacttcccggaagggattgccacctttgtcacggcgagcagcaacctggagctgggatttggcatcgccctggccgtagcgttgcacaatattcctgaaggtctggcggttgcaggcccggtttacgctgcaacaggatcgaaacgtaccgcgattctgtgggcgggcatttccggactggctgaaattctcggtggcgttctggcgtggttaattcttggcagcatgatttctccggtggtcatggcggcaatcatggcggcggttgcaggaattatggtggcgctctccgttgatgaattaatgccgctcgccaaagagattgaccccaataataaccccagctatggcgtgctatgtggaatgtcagtgatgggattcagtttagtgctgctacaaacggcgggaattggttaaagacgataatgacagatgttgcccattgctaaaggcaacatctgtatcgttattaaaggtattattgatgcttttcaaacacttctttatcggagcgtttatctaatttacttcgggcagctaacagcgcatctctgtcatggcgaaaagctttacagtaacgtttaagatgaagaaaatagccaccagccagtagaacaattaatacaatccagtaccaggcaataaacatccttttcaccttcaaaatttaacattactaaacatttagcgttaaaatttcacatatccatcgttgaatacattcatatactcgcataattctggatcaagtatatgatttcgatcatagtaagtgttgtattatataccatatctggtcaaaaaaaagaacaaccaaggctattaatatatattatcccccgataaaacattactaattaataataaaacttaataagcatcgctagatatatattatatcttcacgattattaagcccctactcgttataataagtatacactcccccctttacaacattaggcgtaaacctttgtcaacaaacggttgttttttcgccgcaattcatacaaaaaaattatcacaaataacgataaacaacaaacatctagatatatacacctcaatatataacggggaattatattttaagttttacttaatcagcatttaatataaataacgagtcaaattatctcaggttatggtaatgtccatagctgaattaatattaaattcaaacctgtattttcctcatccatttataaaggattatagtcatgttaaaaaaaacattgttatctatgttcgcaaccgcattgttatcaggcgttgcttttaacgctcttgctgacgatgctaatcagggttcaggtaaaattacttttaaaggtgaagttatcgatgcaccttgttctattgctcctggtgatgaagatcagacaataaacctcggtgaagttgctgataccgtattaaaaagcggtcagaaatcactgcctgtagatgtcaccattcatttgcaggattgtattttatctgacggcactaacactgttgataaagtcaaaatcacctttagttctgccagtgttgacgctaccgactccaacctgcttaaaaacactctggaaggtaacatcggcggcgcaactgatgtaggcgtacgtctggtgaaatcagacaacaccaacgtgactcttggcactccaatcactatcaacttcccgacgactaactcttaccaggagttgaactttaaagcccgtatggagtctctgggacgcaccgcgaccccgggtaacgtgcaggcacaggctaattacgtactcgactacaagtaatcggtagtcaatacctacacaacgccaggcggtaaagccgatgaaatttcatcggcaactttgggcctttttagaaatggatttttatgaacaataaaaacacgttttcccgggataagttatcccatgcaattaaaaatgccctgtctggcgttgtgtgttccctactcttcgttttgccagtccacgccgtagaattcaacgtcgatatgattgacgcagaagaccgtgagaatatcgacatctctcgttttgagaaaaaaggctatatcccccctggtagatacctcgttcgtgtgcaaataaataaaaatatgttgccacaaacgttaatactggaatgggtaaaagccgataatgaaagtggttcgttactctgcttaaccaaagaaaatttgactaatttcggtcttaatacggaatttattgaatcattgcaaaacatagctggcagcgaatgtctcgatttaagccaacgtcaggagttaacgacacgacttgataaagctacgatgatattatcgctaagtgttccccaggcatggttaaaataccaggcaacaaactggacgccaccagagttttgggataccggtatcgccgggtttatccttgattacaacgtgtacgccagccagtatgccccacatcacggagacagcacccaaaacgtcagctcctatggtacgttaggctttaacctcggcgcatggcgcttacgtagcgattaccaatataatcagaattttgctgatggacgctcggtaaaccgcgacagcgaatttgcgcgaacttatctgtttcgccctatcccctcctggtcgtcaaaattcactatgggccagtacgacctgagctccaatctttacgataccttccactttactggcgcatcgctggaaagtgatgaaagcatgctgccgccagatttacagggttatgcgccacaaattaccggcatcgcgcagaccaacgcgaaagtaactgtggcacaaaatggtcgtgtactttatcaaaccactgtcgcgccaggcccttttactatttctgatttggggcaatcgtttcaggggctgctggatgtcacagtggaagaagaagatggccgcaccagcaccttcccaggttggctccgcatccattccctatttaacccgtaaagggcaagtgcgctataaaacgtcactgggaaaaccgacatccgtcgggcataacgatatcaataatccctttttctggacggcggaagcctcctggggctggctgaacaatgtgtcgttgtatggtggtggcatgttcaccgctgatgattatcaggctatcactaccggtattggctttaaccttaaccaattcggttcgctttcttttgatgtcactggagcagacgcgtctttacagcaacaaaatagcggcaatctgcgtggttacagctatcgcttcaactatgcaaagcatttcgaatcgacaggcagtcagattaccttcgcgggttatcgcttctcagataaagattacgtgtcgatgagtgagtacctcagctcgcgtaatggcgatgagtcaatcgataatgaaaaagagagttatgtcatttccttgaaccagtactttgaaacgctggaattaaactcttatctcaacgttacacgcaatacttattgggacagcgccagcaataccaactactccgtatctgtaagcaaaaactttgatattggcgatttcaaaggtatatctgcatcgctggcagtaagtcgaatccgctgggatgacgacgaagagaatcaatattacttctctttctctctacctttacaacaaaaccgcaacatctcctacagtatgcagcgaacgggaagcagtaatacttcgcagatgatttcctggtacgattcatcagatcgcaacaatatctggaatatttcagcgtcggcaacggacgacaatatacgtgatggcgaaccaacactgcgcggcagctaccagcactattcgccgtggggacgtctgaacattaatggcagtgtacagccgaatcagtacaattctgttaccgcaggctggtacggttcacttaccgctacacgtcatggtatcgcccttcacgattatagctatggcgataacgcccgcatgatggtcgataccgatggcatctccggcattgaaatcaactctaaccgtaccgttaccaacgggctgggcatcgccgtgataccttcgttatcgaactacaccacctccatgttgcgggtgaacaataacgatctgccagaaggtgtcgatgtcgaaaactcggttattcgcaccacgctcacccagggtgccatcggctacgcaaaactgaatgccaccaccggttaccaaatcgtcggcgttattcgtcaggaaaatgggcgcttccctccactaggtgtgaatgtcacggataaagcgacaggtaaagatgtgggcctggtcgcggaagacggcttcgtttatctcagcggtattcaggaaaatagtactctgcatttaacctggggtgataatacctgtgaagtcacgccgccaaaccaaagtaacattagcgaaagcgcaataattttaccttgtaaaacagtcaaataattcaggatgaatataatgaaatcaccattaatcacaacaggaatgatttgtttactggggatctgcaactttgcccaggcgactgtctctcccgacagaacacgcatcatttttaatgcttcgaataaaagcgcaacggttcgcctgaccaaccaaagtaaaatcgatccctatctggctcagtcgtggattgaagatgccagcggtaaaaaaacgcgtgattacatctcgacattgccgccgatggaacgtattgagcctgatgaacagatacaaattcgcctgatggcactggcctcgttaaacgacttaccacaggaccgagaaacgttgttctactataacgtgcgagaaattccgccgcgcgccaaagaacagaatgtaatgcaaatcgccatgcaaagccgcctgaagctattctggcggccaaaagcgattgagttaaaagagggggagatgattcctctgcaaaaagtaacgattacccgcaccgccgccggtctgaccctgaataacccgacgccttatcatattaccgtcggttatatcggcactaatggcaagacactgatgcccggtgcggacagtattatggtggtaccatttacttctgcaactcaacacctaagcagcctgccctctaccttccagttaggctttgtggcggactacggcgggctggagatgtttaaagtcgaatgtaattccatccaatccctctgccaaagctctcctgctaagaaggggaaaatatgattacgctttttcgtttactggcgattctttgcctgttttttaacgtttcagcttttgctgttgattgctatcaggatgggtacagaggaacaaccctcataaatggagatttaccagcgttcaaaattccagagaacgcgcaacctgggcaaaaaatttgggagagtggagatattaatatcacggtttattgtgacaatgcaccaggatggacaacagacaatccatcagaaaatatctatgcctggatcaaattaccccaaataaatagtgccgacatgttgaataatccatatttaacctttggcgtgacttataatggtgtagattatgaagggataaatgaaagaattgatactcatgcatgcctggataaatatgagcaatactataatgggtattattatgaccctgtatgcaatggcagtacccttcaaaaaaatgtaacatttaatgcccattttcgcgtctatgtaaaattcaaaagccgcccagcaggagatcagacggtgaactttggcatagtcaacgtgttacaattcgatggcgaaggaggggcaaacatgtcctctaacgcgaagaatttacgctatgtgattacgggattagataatatttcattccttgactgtagtgtcgacgtccggatttttccagaaagccagatagttaatttcgggcaaattgctgcaaactctattgctacttatcgaccaaaagctgcatttagcgtatctactataaaagatgttgctgccgattgtaccgagcaatttgatgttgccaccagcttttatacgacagatacgttacatgatgatacgcatctggaaatgggtaatggtttgttgatgcgtattactgatcaaaaaacacaagaagacattaagtttaatcagtacaaacgcttcaccacatatattccaggtcagactggagcgatggttacccgtgattaccaggctgaactttcacaaaaaccgggggagactctcgtttatgggcctttcaaaaaagatcccatcgtaaaaataaactataactgaacagcaaaatgccgggaacaccccggcattttcatatttagtatttcacgtcattagctggctttacgctcatgtgcctgacggtatgccaccaggtcttcaatagtcacgagcgccatattgtgtttattggcaaactcaatgcactctggtgcacgcgccatcgtgccatcgtcattagtcagctcacacagcacaccagctggtttaaagcctgccagcgtcatcagatcgatagtcgcttcagtatgaccgccacgcgtcagtacaccacctgcctgcgcgcgaagtgggaaaacgtggcccggacgattcagatctgaaggttttgcgccatcggcaatcgctgcgcgaacggtcgtaatacggtcagcggcagaaacaccggtagtcacaccttcagccgcttcaatggtcacggtaaaaccggtgccataggcgctggtgttattttctaccatcattggcagatcgagttgtttacggcgatcgtcagtaatgcacaggcaaacaataccactcccgtggcgaatggtcagcgccatctgctcaacggtcatggtttctgccgggaagatcatatcgccttcgttttcacggtcttcatcatcaagcaccatcacaccgcgtccttcacgcagcgcagccagtgcattttcaacacgttcgaaaggcgtaccaaaagaggaaagtagcgtctgattcatggtaaaaaaacctcactaaaattatggttaccagaatcagggcagtcttaggagtggcggcatatagccaaaataacgtgagcgggtccatgcccgacagaatcgttactctctcccatccggactctaaccgtcggccccggaattacaccggatctgctgtcctttgagttcgcacccaaagcgctcgcgggctttcaactgagttgatttaccgccggtggggaatttcgccccgccctgagaataagcggattcactataacgctaatgattagcgccagcaacgcatagcttcacataattctggtttatgacttacccttatcgcactacaatggcactcaacacctatcagtacagggaaactacaatgattgacccgaaaaaaattgagcaaatcgctcgccaggttcacgaatcaatgcctaaaggaatcagggagttcggggaagatgtggagaaaaaaatccgccaaaccctacaagcgcagctgacgcgtctcgatctggtaagccgcgaagaattcgacgttcagacgcaagtcctgttacggactcgtgaaaaactggcgttactggagcagcgcatcagcgaactggaagcgcgcaataatccgatagcagaacttcaatctcctccggctatcccgccagttgataaagcagaataaagcaccacaaaaacgggccagacggcccgtaatatcagtgttctaattcaagttctctggtttgcatcatctgttggcaataccaggcataacgcgcgcaaaaccaggttctatgttcttcatccatgttaccagtaacggccagaatatcgaccgggcgaccttctgcgtgcattctggcaaaactacgcgcgagaaaatcgaaattatttaaagaattaagactatgatccataagcacatcctccggttattgcataccttttaaggccatatgctttttctgatttcagtattccccaatcagtgtagtgcctttaaacataacgtgcgtaaatatattgtccccgatcacactttttagtgaaaaataaaaaaaccatattaaaagactttctcttccagaacctctctaacatgtgttattattaacaaagacaaatgtaagcaaggaaactattccaaagtaaatattgcgtcactaaatggacattggagtgacatatgattttattcgccgactataacaccccttatcttttcgctatttcctttgtactcttgatcggccttttagaaatttttgcacttatctgcggtcacatgctctccggtgctcttgatgcacatcttgaccattatgattccataaccacaggtcatattagccaggcacttcattatctcaatattggaagattaccagctctcgtcgtcctctgcttactcgctggtttttttggtcttattggcatcctgttgcaacatgcctgcgttacgctctggcaatcaccactccccaacctgttcgtggttcctgtcagtttactgtttacaattattgcagtgcattataccggtaaagtcgttgcaccctggattccacgcgaccatagttcagctattacagaagaagaatatgttggtagcatggcattaattaccggccatcaagccacttcaggtaacccttgcgaaggaaaactcaccgatcaatttggccaaatacattatttgctactggagcctgaagaaggaaaaactttcactaaaggagacaaagtgttaattatttgccgactttctgcaacgcgatatttggcggaaaataatccctggccccagatattgtgatttattaatcaaaaggaaatttaataatggatgatatcgttaattctgtgccctcctggatgtttaccgcgattatcgccgtatgcattctgtttattattggaattattttcgccaggctctatcgtcgcgcttcggcagagcaagcatttgttcgtactggtttaagtgggcaaaaagtggtgatgagcggtggcgcaatcgtgatgccgatctttcatgaaataattcccatcaatatgaataccctgaagctggaagtcagccgctcaaccattgatagcctgattacgaaagatcgtatgcgtgttgatgttgtagtggctttctttgtacgggtaaaaccgtcagtagaaggcatcgccactgcggcccagacgctggggcaacgcaccctgtcgcctgaagacttacgtatgctggtggaagataaatttgtcgatgccctccgtgcaacagcggcacaaatgaccatgcatgagttacaggatacccgcgagaacttcgtgcagggagtacaaaataccgtagctgaagatctgtcgaaaaatggcctggaactggaaagcgtttcacttaccaactttaaccagacctcgaaagaacatttcaatccgaacaatgcctttgacgccgaaggtttaaccaaactgactcaggagacggagcgccgtcgtcgcgaacgtaacgaagttgaacaggatgtggaagtcgcagtgcgtgagaaaaaccgtgatgcactttcgcgcaagttggagattgaacaacaagaagcgtttatgacgcttgagcaggagcagcaggttaaaacccgtaccgctgagcagaatgcgaaaattgcggcttttgaagctgaacgtcgtcgtgaagcagagcagacgcgaattctggctgaacgacagattcaggaaacggaaatcgaccgcgaacaggccgtccgctcaagaaaggttgaggccgaacgtgaagttcgcattaaagagatcgaacagcagcaggtcaccgaaatcgctaaccagacgaaatcgatcgctattgccgccaaatcggaacaacagtcccaggcagaagcgcgtgctaaccttgcactcgcagaagcagtaagcgcccaacaaaacgtagaaaccactcgccagactgccgaagccgatcgtgctaaacaagtggcgttgatcgccgcagcgcaggatgcagaaaccaaagcggttgaactgaccgtgcgggcgaaagcagaaaaagaagccgcagagatgcaggcggcggctatcgttgagttagccgaagctacacgtaaaaagggtctggcggaagcagaagcacaacgtgcgctgaacgatgctatcaacgtactttctgatgaacaaaccagccttaaattcaaactggcattattgcaggcgctgcctgcggtaattgagaaatccgttgagcctatgaaggctatcgacggcatcaaaattattcaggtcgatgggctgaatcgtggtggcgctacgggtgatgcaaacacggggaatgtggggggcggaaacctggcagaacaagcgttatcagccgcactctcttaccgcacacaggcaccgctgattgactccttgctcaatgaaattggcgtttcaggcggctcactggcggcattgacttcatccttaagctcaacaactcccgtcgaagaaaaagcagagtaaaccctcttctatgaataatccctggcccaaaaagccggggattttttatatctgcgttccgctaaaaggtgcaaatgatcaggctgttgcagcattttgcgtgactgctcggggaaggtaaaactgcctctgggaaagcgttgcgcggggtccggcgctcatcaacaatcggggagtcagcaaggggctgaaacgggaaagcccctcccgaggaaggggccttatagaaggaaagggttatgatgaagttcgtcatcatactggttgtgttgttactgttaagtttcccgacttactaacaactcatcagaggggggagaaatcctcccttacccttgttcctttactttaggttgaaaaaacaacagcgtcaatagatctgcctgctacgaagcgagatctgtgaaccgctttccagttagccttttttatccagttggatcttcttgatgatattggtcgtcgagcaaccgtcttcaaagttgagcaccagcacttcgccaccgttggcccagacttctttactcccggcaatctcttctggtttatagtcgccgcctttcaccagcagatctggcaagatcccggcgatcaagcgctgcggcgtgtcctcttcaaacgacaccacccagtcgaccgcttccagtgcgcccagcacaatcatacgctgttcgagcgggttaacggggcgggaatcccctttcagccgtttggtggaggcatcgctgttcacagcgacaatcaaacggtcacccagtttacgggcatttgccagataagagacgtgcccagcgtgcaggatgtcaaagacaccgttggtcatcaccactttttcaccgcgtttacgcgctgccgctacagcaagcttcagttcctcttcggtcatcacaccaaagccggtatctgcacgtccacgtactgcgttttccagctcgatcggcgaaaccgtggatgtccccagtttgccgaccaccacaccagccgccgcattggcaaagaagcaggcttcttccagcgaattacccgctgccagcgttgccgccaggacgccaatcaccgtgtcgcccgcaccggtaacgtcatacacttcctgcgcctgggttggcatatgcagcggcgctttacccggttgcagcagcgacataccctgttcggaacgggtcactaacagagccgagagttcgtaatcggcaatcagtttcatgccgcgctcaacaatctcttcttcggtcttacatttaccgacaacagcttcaaattccgagagattcggcgttaacagcgtagcgccgcggtagcgctcaaaatcggtaccttttggatcaatcagcaccggaacacccgctttacgcgccagttggatcatctgctgtacgcttgccagcgcacctttggcgtagtcagaaagcaccagcgcgccaatcgaactcagtgcctgattaatccgctcgtgcagcggctgcggatcaaccccttcgaaaccttcttcgaaatccagacggatcagctgttggttgcgggaaagtacccgtaatttggtgatggtcggatgcgtcggtacagaaacaaagtcgcatttgacgttgacgtcggccagagatttactgagcgcgcgcgccgcatcgtcaatgcccgtcaacccgaccaggcgtgcattagcaccgagagaagcgatattcatcgccacgttagccgcgccgcccggacgttcttcgatggtattcactttaaccacgggcaccggcgcttccggcgagatacggctggtgggaccataccagtaacgatccagcatcacatcaccaaccaccatcactcctgcacgttcaaactctggcagcgttactttcattcctgtctcctgagagattcaaaatttgcgcgcgataataccatacttcattcttccaccagccacttctgccagcttgcccgcaccagttcacgctctgcggtgaagcaatcctccgacacatggcccggcaattcctgtaatgccagatgatgaagttcatcgcgcagcgttgtgtaagcacgggtcagcgccatcgcttcctgctcttccataatgtcgttttgcgccagtagttccagaatgcgcacgttgtctgaccagcgcgttaacttcggtttttcatgagcgtagcgcaacaccagatattgagtaataaattcgatatcggtaattccgccttcatcggctttgatatcaaagcgatcgcgatgtttattgccgagatgggcacgcattttctcgcgcatttcccgcacttctgtttgcagggttttgccttcgcgcggcagcgtcataatctcccggcgtactgcgtcaaagtgcgcggtgagctgcggatcgccgtacactacacgcgcacgcaccagcgcctgatgctcccacgtccaggcctcgtttttctgataatcagcaaatgcttctgcggatgtcaccagcattcccgccgccccggacggacgcagtcgtgcatccacttcatacaaaatgccggaagaggttcgcgtactgaacagatgcatgatgcgttgcgccagacgcagataaaactgtcgcccgtcgatttcccgctcgccgtcagtcatcgcatccattgggcaatcatggaggaagatcaggtcaagatcggaactgtagcctaactcccagccacccagcttgccgtagccgaccaccgcaaaaccacgcccttcgcgttcgttcaggtgatttggcttaccgtagcgggcaaccatttgaacccacgcctgctgaacgacggcatcaatcatggcttctgccagccaggttaagtgatcgctcactttcattaccggtagcgtaccggcgatatccgctgccgcaatgcgtaacagctgcgcctgtttgaactgacgcagcgcctcaagctgttgttcttcgtcatcttccggcacgcgcagcaaatactggcgcagttcatcacggtaggcatccgtcgccgttggttggtagagggtatttggatcgagcaattcatccagcaataatggataacgcgctagctggctggcaatcatcggcgatgcagcacacagagaaatcaaatgtttaagcgccgcagggaattcactaagcagctcaagataagtggtgcgagtaacaatccccaccagcaaggcggtaatgcgcgacagcgtgacagcagcgtcttcacgcgcacagacatcacttagcagatgtggcatcagatggtcgagcacctgacgtcctcgcggcccgatggtgcgcttatccagctctttgcgaaaatcagcaatcagcattagcacctgtttgcgctcatcctcgctaagatgcgccagcactggcgtggtgtcatcttcctgcaacgcatcctgccacagctcacgccactgttccgacagcgactcttcctgagtttcactttcgtcgtcgccaatcaattcattaaacacccggcgcacattggccatatgtgcggtcagcaccccggtcaattgcggccagtcagcaaagtccatcgcccacgccagccgcgcacgggtaagctcatcagaaggaagcgtctgggtttgttcgtcgttaatgctttgcagcaggttttccagacgccgcaggaacagatacgccactcgcaattgttcagcatcgttttcagaaagcagatgcagcgcggcaatggcgctgagcgttggcagtaaagcgcgcgattgcagcgacggttcgcgcccgccgcgaatgagctggaacacctggacgataaattcaatttcgcgaatgccgcctgcgccaagtttgatgttgtcggtcaaaccgcgtcgacgcacttcacgggcaatcattcctttcatgttgcgcagcgactgaatcacgctgaaatcgatgtaacgacggaaaacaaacggacgcagcatcgcacgcaactcgttagcatagacgccgtcgctatcccccataatccgcgccttgaccatcgcgtaacgctcccagtcgcgcccctgctcctggtaataatcttccagcgccgcaaaactcagcaccagcgggccactttcaccaaacggacgcagccgcatatccacgcgatagacgaagccatcctgcgttggttgatccagcactttaatcagccgctgccccatgcgggtaaaaaactgcgcgttatccagttcccggcgtccaccctgggtacaaccatgttccggccaggcaaaaatcagatcgatatcagaggagaaattcagttccccgccgcccagcttacccatgcctaaaatcagcagcggttgcgcttcgccctgcgcattgcacggcgttccccattcgcggcagcaggcgtcatacagccagtcacgcgccgcaacaatcagcgtctccgccagatggctgagctgctgcaatatgctctcttcagtaaccagagccagcgtttgcgcccaggcgatgcgcaccataatgcgccgccggaatagccgcagctcgcgcattaacccggcttcgtcactcacattactgagcgcctcctgcaaccatgcagcgtaatgctgccattcgtcggcctgcggcggttggctttccagttccgtcagccactctggatgcgcaatcacgctgtcctgcacaaaatcactgaaagtaagtactgacttcgcctgtgcgctaagtgattcctcggctaaaggctctggcagccgctcaacaacggtctgccagtactgctgtaacggtgaagagagcggcttcataagcgattttatccttgcctgattaacgttttccgctgtgcaaccagaacggttcctgattgtttgcctcattacggaaatgttcaatttcaatgcgttgcccggtcgcaatagcgtgacgcagcccctgccagttctccagccagtcttgcgcgacgacaggatcgtagtaacccgccagcaacagtattgagtcaatatcacgcgtcaggcgtggcaattggtcacggtagcgatcgcctaacggctggcagaaaacgcttttaagttcagcagcatggcgggaaagatggatatcggcaaagcgtttgaaggaatcgctcattttaccctgcgctttggcatctaaaaacggctgccaggctttgcttaccagccattcggtcaacgccagcttcgccattgccgtttcggtagagtagaccgccgttacggcagaaaccgcagaagcaatggtcgcctcgcattgagtcagcagatcacgtaagtgagtgctcgctttacgcggcacgataccgccgaacagcatcagtgtatgacggaccaggccaatggctgccagcacctgctctttcgccgcatcgttgccgcgtacccacagttcttcatgatactgccattgcgctaacgccagctcgagcgccgcttccagcccctgttccacatcagcttttgccgcaacatgcaaaatggtggtcggtttgatttcacgcgccggattgccctgcgccagatgatagccacgcgctgctttgctcaggctgccctggcgtaatccggtttgcgataccagttggttcgccagtttcagcaccgcacgcatgtcgccgctaagcagttccagttccagctcacagataggttcagcaaattcacccgctttcacttccccctggtcgagggcgatttcaatttggctaccatcaacctctaccagccacttttcgcgataaaaatcggtgctgaacagcggttgtacgcgggaagcgagatcggcaggcaattcgccgttcggccagacttccgtcggtaactgcgccaggtcgagcgtcggtgcgctcaacgccacgttatattccgggcgctggtgtaagccgcctgtcactcttcctgcaactttcatggtcatctcatagcgaccgttttcgccacgaatacgcaagcccatatcgtgcccacgcagccagttatccggcgtttcgtagtaaatattcagcaactgcacggggtcatggtgctcgccgtccagcgtattgagatggtcacgcagcgcctcaacggcactgtgattaacaataaactttaattcgatttcctgagccatagcctttacttatcggttatgtcacataagtgacgatgaacggcgaacttaatgcgatcttttttgtcagtagatagtattttgcgccaaattgccatgcaacgggcaatttgacgggcgtaaaagtttgaagcagtggcaagacctgacacagaggattccgattgatgtcgaatgctttgcgtagcgacactgatgccactactatcgttccactttccatgacaataacgacagcctgatgccaaaattacgcctgatcggattaactttactcgcacttagcgccactgccgtctcacacgctgaagaaacgcgctatgtttctgatgaactgaatacctgggtccgtagcggtccgggagatcattatcgcctcgtgggcacggttaacgccggcgaggaagtgaccttattacaaactgacgccaacaccaattatgcccaggtgaaagacagctctggccgtaccgcctggatcccgttgaaacaacttagcactgagccaagcctgcgctcccgtgtgccagatctggaaaatcaggtcaaaaccctgaccgataaactcaccaatatcgataacacctggaatcagcgcaccgcagaaatgcagcaaaaagtggcgcagagcgacagcgtgatcaacgggttaaaagaagaaaatcagaaactgaaaaacgagctgattgtcgcgcagaaaaaggtcgatgccgccagcgtacagctggatgacaaacagcgcaccatcatcatgcagtggtttatgtatggcggtggcgtgctggggcttggcttgctgctcggtctggtactgccgcacctgatcccaagccgcaaacgcaaagatcgctggatgaactaaatcgccttcttcgttgcactgtcttattattaggaattgtgtatttgacgaagggatgatggcgtgaagatttatctggtcggtggtgctgttcgggatgcattgttagggctaccggtcaaagacagagattgggtggtggtcggcagtacgccacaggagatgctcgacgcgggctaccagcaggtaggccgcgattttcctgtgtttctgcatccgcaaacgcatgaagagtatgcactggcacgtaccgaacggaaatccggttccggttacaccggttttacctgctatgccgcaccggatgtcacgctggaagatgatcttaagcgtcgcgatctgaccattaatgcgctggcccaggacgataacggcgagattatcgacccgtacaacggtctgggcgatctgcaaaatcgtctgttgcgccatgtttcccccgcttttggcgaagatccgttacgcgtgttgcgcgtagcgcgttttgctgcgcgttatgcccacctctgtttccgtattgccgatgaaactctggcgctgatgcgcgagatgacccatgcgggtgaactggaacacctgacgcctgaacgggtatggaaagagacggaaaacgccctcaccacccgcaatccccaggtgttcttccaggtactgcgcgattgcggcgcactgcgcgttttattcccggaaattgacgccctgtttggcgttccggcccctgccaggtggcatccggaaatcgacaccggtattcataccttaatgacgctctcaatggcggcgatgctgagtccgcaggtcgatgtccgtttcgcaacgttatgccacgatctcggtaaaggactgacgccaccagaactttggccgcgtcatcatggtcatggcccggcgggtgtgaagttagtggaacaactatgccagcgtctgcgcgtgccaaatgaaattcgcgatttagccagactggtggctgagtttcacgatctcatccacaccttcccaatgctgaacccaaaaaccatcgtcaaactatttgattccatcgacgcctggcgtaaaccgcagcgtgtcgagcaactggcgctgaccagcgaggctgatgtgcgcggcagaaccggttttgaatcagccgactacccgcaaggccgctggttgcgcgaagcctgggaagtggcacagtcagtgccgacaaaagccgtcgttgaagcgggatttaaaggtgtggagattcgcgaggagctgacccgacggcggattgcggcggtggctggctggaaggaacagcgttgcccaaaacctgagtgagtgttggatattttgccggatgcgacgtaagcgtcttatccggctacatgtcaacgacagttgtaggcctgataagacgcgcgagcgtcgcatcaggcgttgattgccggatgcggcgtgaacgccttatccggcctacgcaatctgataagacgcgtcagcatcatatccgacactgttcttcacatcaaaagaacacaacgtacaccgcagccgccacaataaagcgataaatggcgaacgggataaacgaaatgcgcttaatcaattgcaggaaggttttaatcgctatcagcgccaccacaaaagcggtgataaacccaacggcaaacatcgggatatcgccggtagtcaggaagccccagcttttgtagagatcgagcgccgttgcgcccatcatcatcggcaccgccagcaggaacgagaactcggaagcagcgtaacggctcacccccatcagcatcccacctgaaatggtcgccccggaacgggagaaacccggccacagcgccagacactggaaacagccaatcataaacgcctgacgataggtcatatcatcaagacccggcgcacgcggctctttcggcttcaggcattcggcggcaatcagcaacagaccgccaacgaccagtgcatacatgacatttatcgggttaaacaatgatttaatcgtgtcgtggaacaacagccccagtaccaccgccggaatcatccccagcaagatgtggatcagcgttaaacgacctttgctttctccttcgtgctgcaacgggcgaccaaagtggatgccaatcaggccaaacagacgccgccagaacatcactactaccgccagaattgatcctaactggatcacgacttcaaaggttttcgccgtgtcgccctcaaaccccaacaagtgaccgacaataatcatatggcccgtgctggataccggcagaaattctgtcaatccttcgaccacacccaatattgccgctatcagcagcgagtgcatatcgctcatcaataaacccctaaattataaaaatgtaacgcttgtccgaactactgcagtatgaccaggttataatcgtttggtttaacagctgtaaaattaattattttctttcagattattgccacgctcaatgattacgccaacattcgccgcccgcgccactgcgcctggcttgctgagtttgatacgcacccacggcgagttgaagcgtgctaacagcagctccgccacctcttcagccacgcgttccaccagcgcaaaacgcgctccctcgacgtggctgaccaccgtttctgcaatgtcagcgtaactgaggcaatccgccacatcatcacttttcgccgctttacggttatcccacgccatttcgatatcgaacactaacttctgttcgatggtctgttcccagtcgtaaacaccaatagtggtgattaccgaaagttgctctataaatacaatatccatcacgtcctgcctgctttttggctaaccggataccacttccggcgaaatgtgcgtattatccacagattcatcgttgaacacgaattttcaaaacggaacagcttatgagtgcaatcgcgcctggaatgatcctcatcgcgtacctctgcggctccatttccagtgccattctggtttgccgcttgtgtgggttgcccgatccgcgaaccagcggctccggcaatccaggcgcaaccaatgtgttacgtatcggtggcaagggagcagccgtagcagtactgattttcgacgttctgaaaggaatgttgcccgtctggggcgcgtatgaattaggtgtcagccccttctggctaggcttaattgccatcgccgcctgtcttggacacatctggcccgttttcttcggttttaaaggaggaaaaggcgttgctaccgcttttggtgccatcgcacccattggctgggatctcactggagtaatggcgggaacctggttactgaccgtgctattgagtggttactcgtcgctgggagcgattgtcagtgcactgattgctccgttttatgtctggtggtttaagccacaattcaccttcccggtttcgatgctctcttgcctgatcctgctgcgtcatcatgacaacatccagcgtctgtggcgtcgtcaggagacaaaaatctggacgaaattcaaaagaaagcgcgaaaaggatcccgagtgatttctggtggatctacatgacctgatagccttcgtcgggcttgcccagccgttgctggcaccatgccgccagaaattccacacagacacgtaatttcatgctgcgatagagcggctcccggtaaacagcccagatattggcgctttgtgcatactccggcaatactcgcaccagtttgccactctccagaaacggcaacacatcccactcggaacgcagcataatccctttgccctccagcgcccattgcagcacaatctcgccgctattggaggaaagatgtccgcttaccttcaccgattttttctcctgaccgttccccaactcccatattccgtgggtcatatcgcgctctttggtcaccaggcagtcatgacgacttaattcctgtaaggattgtggctgcggatatttttgcagatactcaggtgctgcgcataatattcttttattttttgtcaaaagatgcgcaatataataatcaggaattgcgtcattaatacgaatatccagatcaatattatcctgcactaaatcaatttgtcgatcgaacaattcaaaatgcacctgtaactcaggataattgcgcatcagttcggtaatagctggcgcaatatggctgcgcccaaaaccaaaactgcaaccaatgcggatcatcccctccgggcgcgttttgatttgcgtgacgtcatcgaccagtcgctgatattgggtgaggatttccagcgcatgttcgtaacaacgctggccactttcagtcagcgccacgccgcgagcggagcggttcagcagagttgttgccagcgtattttcaaggatttggatccgcttggtgacaaatgcaggcgtttgcccaagcgtcgccgctgcagcactaaaactcccgctatggacgatttccaccagtacctgcaagtctttggctaaaggccagctatttagcattgttaaatatccgcagttttgataaacgcagtgtatttcgcaaaacattaccattccctgctctggcgcaatattcgttcttattttcgcgttgattcacgaactgttaattacatattcacggtggcaaaaaatataaaaccacatttttagtggtagtttgtggcggtgaatttttccagacaaatacataaactggagttgccatgatgagcgaaagtaataagcaacaggcagtgaataagttgacggagattgtcgctaactttaccgccatgatttctacccgaatgcctgatgacgtggtggataaactaaaacagctaaaggatgccgaaacatcgtcgatgggaaaaatcatctaccacacgatgttcgataacatgcaaaaagcgatcgacctgaatcgtcctgcctgtcaggacaccggcgaaatcatgttttttgttaaggtcggttcccgtttcccactgcttggcgagctgcaaagcatactcaaacaagccgtggaagaggcaaccgtcaaagcgccactgcgtcacaatgcggtagaaatttttgacgaagtaaacaccggcaaaaataccggcagtggcgtaccgtgggtcacctgggatatcgtccccgacggtgacgatgcggaaatcgaagtttacatggcaggcggcggctgcacgctacctggccgatcgaaagtgttaatgccgtcagaaggctacgaaggcgtagtgaaattcgtcttcgaaaatatctccaccctcgccgtaaacgcctgtccgccggtacttgtgggcgttggcatcgctacctcggtggaaaccgccgcagtgctctcgcgtaaagccattttgcgcccgattggcagccgccatcccaatccaaaagcggcagagctggagctacgcctggaagaaggactcaaccgtctggggattggtccacaagggctgactggcaacagttcagtgatgggcgtgcatatcgaatctgccgctcgccatccgtcaaccatcggcgttgctgtttctaccggctgctgggcgcatcgtcgcggcacactgcgagttcatgccgatctcacctttgaaaatctgtctcatacccggagcgcgttatgaaaaagatcctgacaaccccgatcaaagctgaagatctgcaagatattcgcgtcggcgatgtgatctacctgaccggtacgctggtgacctgccgtgacgtttgtcaccgccgattgatcgaactgaaacgtccgatcccttacgatctcaacggcaaagcgattttccacgctggccccatcgtgcgcaaaaacggcgacaaatgggagatggtgtccgtcggcccgacaaccagtatgcgtatggaaagttttgaacgtgaatttatcgagcagaccggcgtgaaactggtggtcggcaaaggcggaatggggccgctgaccgaagaaggctgccagaaattcaaggcgctgcatgtgattttcccggctggctgtgcggtactggcggcaactcaagtggaagagattgaagaggtacactggacagaactcgggatgccagagtcgctgtgggtctgccgggtcaaagagtttggcccgctgattgtctctatagatacccacggcaacaacctgatagccgaaaacaaaaagctgttcgccgaacgccgcgatcccatcgtggaagagatctgcgagcacgtccactacatcaaataaccctcccggagaggctcgcccctctcctttttctcaggcataacacgatgaaaccttccactgaatggtggcgataccttgcgccgctggcggtcatcgccattattgctctacttccgcttcccgcagggctggagagtcatacctggctctactttgccgtttttactggcgtgatcgttggactgatcctcgaacccgtgccgggtgccgtggtggcgatggtgggtatatccatcatcgccattctttcgccgtggctgctgtttagcccggagcagctcgcccagccaggttttaagttcaccgccaaatccctctcctgggcggtttctggtttttctaattcagttatctggcttattttcgccgcctttatgtttggtacgggctatgaaaaaaccgggcttggacgtcgcatcgctctgattctggtgaaaaaaatggggcatcgcacgctgtttctcggctatgcagtgatgttctccgagctgatactcgcgcctgtaacaccgtccaactcggcgcgtggtgcggggattatctatcccatcatccgtaacctgccaccgctctatcaatcacaaccaaacgacagcagttcgcgcagcattggctcgtacatcatgtggatggggattgttgccgattgcgtgaccagcgccattttcctgacggcgatggctccaaatttgctgttaattggactgatgaaaagcgcatctaacgccacgctgagctggggcgactggttcctcgggatgttgccgctcagtattttactggttctgctggttccctggctggcttacgtgctgtacccgccgatactgaagtctggcgatcaggtgccgcgctgggcagagacggaactgcaggcaatgggcccgctctgttcgcgtgaaaaacggatgctggggctgatggtaggcgcactggtgctgtggatttttggcggtgattatatcgatgccgcgatggtcggttacagcgtggtggcgctgatgctgcttctgcgcattatctgctgggacgacattgtcagtaataaagcggcgtggaacgttttcttctggctggcctcgcttatcaccctcgctaccggactcaacaacaccggttttattagctggtttggcaaactgttagcaggcagcttaagcggttattcgccaacgatagtgatggtggcgttgattgtggtcttttatctgctgcgctacttttttgccagcgccacagcgtatacctccgctctcgcaccgatgatgattgccgccgcgctggcgatgccggaaatcccgctgccggtgttctgcctgatggttggtgcggcaattggtctggggagcattcttacaccatacgccaccggacccagtccgatttactacggtagtggttatctgccaacggtggattactggcgactgggggcaatttttgggctgatattcctcgtgttgctggtgattaccggcttactgtggatgcccatggtgttgctttaagtgaggacggtgccggaaattgctctccggcacctaatagttttacgcggccggtaactctgccagcggccagcgcggacgcacgctaacgccgagatccgccgtcgcgcctgctttaaaccgcaccattccggcataggcgatcatcgcaccgttatcagtgcaaaattccggacgcgcgtagaacacttcgccacgacgctttttcatcatttcagccagcttcgcccgcagtgtgcggttagcactcacgccgcctgccatgaccagtcgcttaaagcccgtctgatccagtgctcgcttacacttaatcatcaacgtatcgaccactgcatcttcaaaggcgcgggcgatatcggcacgcgtctgatcgtcagtgccgttgtcacgtatggtatttgccgcgaaggttttcagaccagaaaagctgaaatccagccccggacggtcggtcatcgggcgcgggaagacaaagcgcccggcagtaccctgagccgccattttcgacagtaatggcccgccaggataatccagccccagcagcttcgcggttttatcaaacgcttcaccagccgcatcatcgatagactctccgagcagctcgtactgaccaatgccagtcacgctgattaactgcgtatgaccgccggaaaccagcagcgcgacaaacggaaattccggtgggttatcttccagcatcggcgctaacagatgtccttccatatgatgtaccgggattgccggaacgtcccaggcaaacgccagagaacgccccacggtcgcgccaaccagcagtgcgccgactaatcctgggcctgcggtataggccacagcatcaatgtcttttgccgttaaaccagactcctttagcgcctcctggatcaacggtacggttttacgcacgtgatcgcgggaggccagttcaggcacgacgccgccgtagtcagcgtgcaatttcacctgactatacaattggttggctaacaaacctttttcatcgtcgtaaatggcgatgccggtttcatcgcaggaagtttcaatacccagtacacgcatgacttgttttacctcgctttattaccgcgcagtgtaggaccaatgcgggttgatgtaaaactttgttcgcccctggagaaagcctacgtgtatacttccttcacccttataaaagtcccttcaaaaannnnncattccattcattaattaattaatgaatgaatgnnnnnggtgttctggcggaagttcgtcgtcgtgagttctatgaaaaaccgactaccgaacgtaagcgcgctaaagcttctgcagtgaaacgtcacgcgaagaaactggctcgcgaaaacgcacgccgcactcgtctgtactaattccccgagagcgttgctctccgatcagaccgagttgtagttgtaaggccgtgcttccgaaaggaatgcgcggcttattttcgtttatgaattgctaaaaatcggggcctatggctggacgaatcccacgcgtattcattaatgatctgctggcacgcactgacatcgtcgatctgatcgatgcccgtgtgaagctgaaaaagcagggcaagaatttccacgcgtgttgtccattccacaacgagaaaaccccgtcattcaccgttaacggtgagaaacagttttaccactgctttggatgtggcgcgcatggcaacgcgatcgacttcctgatgaactacgacaagctcgagttcgtcgaaacggtcgaagagctggcagcaatgcacaatcttgaagtgccatttgaagcaggcagcggccccagccagatcgaacgccatcagcggcaaacgctttatcagttgatggacggtctgaatacgttttaccaacaatctttacaacaacctgttgccacgtctgcgcgccagtatctggaaaaacgcggattaagccacgaggttatcgcccgctttgcgattggttttgcgccccccggctgggacaacgtcctgaagcggtttggcggcaatccagaaaatcgccagtcattggttgatgcgggcatgttggtcactaacgatcagggtcgcagttacgatcgtttccgcgagcgggtgatgttccccattcgtgataaacgcggtcgggtgattggttttggcggacgcgtgctgggcaacgatacccccaaatacctgaactcgccggaaacggacattttccataaaggccgccagctttacggtctttatgaagcgcagcaggataacgctgaacccaatcgtctgcttgtggtcgaaggctatatggacgtggtggcgctggcgcaatacggcattaattacgccgttgcgtcgttaggtacgtcaaccaccgccgatcacatacaactgttgttccgcgcgaccaacaatgtcatttgctgttatgacggcgaccgtgcaggccgcgatgccgcctggcgagcgctggaaacggcgctgccttacatgacagacggtcgtcagctacgctttatgtttttgcctgatggcgaagaccctgacacgctggtacgaaaagaaggtaaagaagcgtttgaagcgcggatggagcaggcgatgccactctccgcatttctgtttaacagtctgatgccgcaagttgatctgagtacccctgacgggcgcgcacgtttgagtacgctggcactgccactgatatcgcaagtgccgggcgaaacgctgcgaatatatctacgtcaggaattaggcaacaaattaggcatacttgatgacagccagcttgaacgattaatgccaaaagcggcagagagcggcgtttctcgccctgttccgcagctaaaacgcacgaccatgcgtatacttatagggttgctggtgcaaaatccagaattagcgacgctggtcccgccgcttgagaatctggatgaaaataagctccctggacttggcttattcagagaactagtcaacacttgtctctcccagccaggtctgaccaccgggcaacttttagagcactatcgtggtacaaataatgctgccacccttgaaaaactgtcgatgtgggacgatatagcagataagaatattgctgagcaaaccttcaccgactcactcaaccatatgtttgattcgctgcttgaactacgccaggaagagttaatcgctcgtgagcgcacgcatggtttaagcaacgaagaacgcctggagctctggacattaaaccaggagctggcgaaaaagtgatttaacggcttaagtgccgaagagcgatcgggaagcccccgacagccgcactgagaggcagcggcaaatatataagtacgccctcgtaattatcgttggcggtaaacaaccgttggatttcagcgttaacggctgaaggacatcgggtcaatcgcccaacaccaacctcatgaaataagtgtggataccgtcttatggagcaaaacccgcagtcacagctgaaacttcttgtcacccgtggtaaggagcaaggctatctgacctatgccgaggtcaatgaccatctgccggaagatatcgtcgattcagatcagatcgaagacatcatccaaatgatcaacgacatgggcattcaggtgatggaagaagcaccggatgccgatgatctgatgctggctgaaaacaccgcggacgaagatgctgccgaagccgccgcgcaggtgctttccagcgtggaatctgaaatcgggcgcacgactgacccggtacgcatgtacatgcgtgaaatgggcaccgttgaactgttgacccgcgaaggcgaaattgacatcgctaagcgtattgaagacgggatcaaccaggttcaatgctccgttgctgaatatccggaagcgatcacctatctgctggaacagtacgatcgtgttgaagcagaagaagcgcgtctgtccgatctgatcaccggctttgttgacccgaacgcagaagaagatttggcacctaccgccactcacgtcggttctgagctttcccaggaagatctggacgatgacgaagatgaagacgaagaagatggtgacgacgataccgccgatgatgacaacagcatcgacccggaactggctcgcgaaaaatttgcggaactgcgcgctcagtacattgtaacgcgtgacaccatcaaagcgaaaggccgcagtcacgctgccgctcaggaagagatcctgaaactgtctgaagtattcaaacagttccgcctggtgccgaagcagtttgactacctggtcaacagcatgcgcgtcatgatggaccgcgttcgtacgcaagaacgtctgatcatgaagctctgcgttgagcagtgcaaaatgccgaagaaaaacttcattaccctgtttaccggcaacgaaaccagcgatacctggttcaacgcggcaattgcgatgaacaagccgtggtcggaaaaactgcacgatgtctctgaagaagtgcatcgcgccctgcagaaactgcagcagattgaagaagaaaccggcctgaccatcgagcaggttaaagatatcaaccgtcgtatgtccatcggtgaagcgaaagcccgccgtgcgaagaaagagatggttgaagcgaacttgcgtctggttatttctatcgctaagaaatacaccaaccgtggcttgcagttccttgacctgattcaggaaggtaacatcggtctgatgaaagcggttgataaattcgaataccgccgtggttacaagttctccacctacgcaacctggtggatccgtcaggcgatcacccgttctatcgcggatcaggcgcgcaccatccgtattccggtgcatatgattgagactatcaacaagctcaaccgtatttctcgccagatgctgcaagagatgggccgtgaaccaacgccggaagaactggctgaacgcatgctgatgccggaagacaagatccgcaaagtgctgaagatcgccaaagagccaatctccatggaaacgccgatcggtgatgatgaagattcgcatctgggggatttcatcgaggataccaccctcgagctgccgctggattctgcgaccaccgaaagcctgcgtgcggcaacgcacgacgtgctggctggcctgaccgcgcgtgaagcgaaagttctgcgtatgcgtttcggtatcgatatgaacaccgaccacacgctggaagaagtgggtaaacagttcgacgttacccgcgaacgtatccgtcagatcgaagcgaaggcgctgcgcaaactgcgtcacccgagccgttctgaagtgctgcgtagcttcctggacgattaatcggtaggccggatcaggtgttacgccgcacccggcactagtccctccgcacaaacgccaccttttcggtggcgttttttatcgcccacgcactaccagcgcctggtccagctcgcgatacgcttcaaccagtttctccagtgaaacgcgacttaaaccgctgggatttggcagcacccaaatctgcgtcgaaccaatggtgagagtttgtttcccccactgtgcaccgcgctggctgaatccctgttcatatgcttgtttgcccagaatcgccaacgcctgcggctgataatcttcaattttttcaatcagcttacgcccgcctgcgtgtagttcttgctttgaaacttcattggcttgcaccgttggacggtctaccagtttggtgacgccacaacgataatccagcagatgctgtgcctcctgcggcttcaactgacggtcggtaaacccggcctgatatatcaccttccagaagcgatttgccggatgagcaaagggaaaaccagtcccggcggatgaaagcccagggttgataccgcaaaacacgacccgtaaccctggagccaaaatatcctcaaccatatttactcctttctaacatcaccaggaaaagtataacggattgaaaatacattgtttataaaaacagcaggcgcgcggtaatggctggattgcgacacggagttactttataatccgctaccatggccccttagctcagtggttagagcaggcgactcataatcgcttggtcgctggttcaagtccagcaggggccaccagatatagcaaaggctgacgagaaatcgtcagcctttttctttttatatatcagttactttgcgtgccagtaagccgctgcacgtacccgctgtgggtcatactgttccgcttcaaagcggcggcttaaattcttaacgactttgccttcgccggttatccagatgaagtaatcatcggcagggatttgcatctgcgccagacgctcatctaccgcctgctcatcatgtgccagccattcgatattaaaaccatcaaggtgcgcgagataatcctgacaggcgttatcccgcacgctaaccagcgcgctaacttgcggtttaacggcaagtttgctcaacgtttccaggcggcggcgcagtgcgggcattccggattcatcgcagacatacagctgatacgcgtaatcctctggcaccaccagcgaaccgcgcggacctgccaccgtgagtttatcgcccggttgcgcctgcatcgcccagccgctggcgacgccaccgtcgtgaataaagaaatcaatcgccagttcatggcgtagttcgtcatacagcggcgtatagtcacgcgacggtgggcgtggtccttccggccagacgatgccctcttccgttaccgttggcggcacaaagtgagcatcagattgaggaaagaagagtttgctgtgatcgtcaaagccgcgcgatgtaaaaccgtccagcgcctcgccgccaaggacaatgcgctgaaaaccggcgctaatacgctcagcgcgtagcacagtcaattcacggaagcgcagatcattgcgaacgcgctgcgggtagcggggggagttattcattgttatcgccttcgtgatagtaatcagatatatctaaataaatttcgcaaatgataatgattgttaatcatgataaatgcaagcgatttgtagaactgatatatctgaagtatgagaagacattcagcgtcgtagcaaggctgctggatgcggcgtgaacgaattatccggcctggatgtgaggtgtattcacgtttaaaaatcatttttatacttgcaaaagcgctcatatcagatataaattagatatatctaattaagcaaaaggaggctgatatgagctatcatcacgaagggtgttgtaaacatgaaggccagccacgccatgaaggctgctgcaaaggtgagaagtcagaacatgagcactgcggacacggtcaccagcatgaacacggtcaatgctgcggtggtcgccacggtcgcggcggcggtcgtcggcagcgtttctttggtcacggtgaattgcgtctggtgattctggatattctctcgcgcgatgacagccacggttacgagttgattaaagcgattgaaaatctgacccaggggaattacaccccaagcccgggcgtcatctacccgacgctggattttctgcaggagcagtcgctgattaccatccgcgaagaggaaggtggtaagaagcagattgcgctgaccgaacagggcgcgcagtggctggaagaaaaccgcgaacaggtggagatgattgaagaacgcatcaaagcgcgttgcgttggcgcggcgctacgccagaacccgcaaatgaagcgggcgctggataattttaaagcggtgctggatttacgcgtcaaccagagcgatatcactgatgcacaaataaaaaagatcattgcggtgatcgaccgcgccgcttttgatattacgcaactggattaatcgccgcatccgccagtggcgcggtgcaattgccggatgcgacgcttgacgcgccttatccggcctacacccgctacacaccccgtaggcctgataagatgcgccagcatcgcatcaggcattgtgctccaaccgctggatccggcataccgattaatgcagcaccgtcaccgcgtcttccagtcggctggcgcggtgtttcaccatcgccgacacctgcgcactctcttccactaactcggcgtttttctgggtgatgagattaagctcatccactgcacgggtcaggctggaaagcccatcggcctgttccagcgttgaatggctaatctgagctatcaactgggtgacgttttttacctgcgccacaatatcttccatcgtccgtccggcggcgtgtacctgctgcgaaccagattgcaccttatcagcactggcatcaatcagcttgcgaatatcgttggcagcattggcgctgcggctggctaaatgacgcacttcccccgccaccactgcaaaacctttgccctgttcgccggcacgcgccgcttccaccgccgcattcagggccagaatattggtctgaaacgcaatatcgttaatcagcgaagtaatggtgccaatgcgctgggtactgtcggcaatatcgtccattgtcttgatcaccgtagtcatcgcctccccgccctgcactgccgcattactggcggtgatagaaagtttatcggcagccgacgccgtggcagagttctgtttcaccgacgccgccatttggttcatggtcgccaccgtttgctgaacgttatcaactgtctgctgggtatgttcgttcagttcatcggtgcctttcgccagcgtctcactgccatttctgacactggacacctggcttgagacatcgttaattagccaacggcacatcaggccaagctgccctaccgcgcgtaatgtcagccccagctcatcgctgcgattcagatgctcaacactattacgctctccggtcgccaccttcagtgcctgacgggcgacattttctatcgggcggacaatctgccattcaaaacaggcgcttgccaacaataccactaacgcacagaggatatacgtcaccaccggggcagcaacaaaccaaagcatgaccgccagcaagataaacatcagggtcatcacgccacgcgcccgccagcgaagcggtaatgaaggcagtttacccagccagcctttacgcaccaccaggcctttatgaatacgcttactggtacgtccggcgttcaacgctttgtacagcggctccaccgccgcgatctcttcatccgtcgcccgggtacgaatcgacatatagccactgatttttccctcgcgcaccatcggtaccgcattggcccgcacccaataatggtcgccatttttgcggcgatttttcacgatgccgctccagggctccccttttttcagggtgaaccacatatccgcaaacgccgcttttggcatatccgggtgacgcaccatgttgtgcggttgaccctgtaactcctgcaaggtatagccgctcacctgcacaaaagtgtcattagcatgagtgatatagctttgcagatcggtagtggacatcagagtggtgtcgtccgccagcggggtattttgctgggtgacatacggatgagaagacatgttcgcgtcctgtgcaggttatatggttgttaacttcttgtcagagtttatgtcggccccgctgcggttatctttaaccaattaatttgatttagatcgcaatttgcgattaaagcacaaatctaattccttgatttaaaatactttcactctgttactatacgaaaacgttaattatcttgcccaaaaatcaggcaattattgccctgaaagcgtgcatttgcgcagcaatcatcaaatccatacccgacaaaaaccgtgcaaaataacagcaaatgttagcaaatagcattaaatattgcgcaaatgataaccatgtttgtgtttatcccgattttcgcgatcgcagccggagtggcgcaatccctgcaatacttaaatcggtatcatgtgatacgcgagcctccggagcatattttgaacaggttaccttcgagcgcatcagctttagcgtgcagcgcccacgccctgaatctcattgaaaagcgaacgttggatcatgaggagatgaaagcacttaaccgggaggtgattgaatacttcaaagagcatgtcaatccggggtttttagagtatcgcaaatctgttaccgccggcggggattacggagccgtagagtggcaagcgggaggtttaaatacgcttgtcgacacccagggacaggagtttatcgactgcctgggaggttttggaattttcaacgtggggcaccgtaatccagttgtggtttccgccgtacagaatcaacttgcgaaacaaccgcttcacagccaggagctgcttgatccgttacgggcgatgctggcgaaaacccttgcggcgctaacgcccggtaaactgaaatacagcttcttctgtaatagcggcaccgaatccgttgaagcggcgctgaagctggcgaaggcttatcagtcaccgcgcggcaagtttacttttattgccaccagcggcgcgttccacggtaaatcacttggcgcgctgtcggccacggcgaaatcgaccttccgcaaaccttttatgccactgctgccagggtttcgtcatgtaccgtttggcaatatcgaagccatgcgcacggctcttaacgagtgcaaaaaaaccggtgatgatgttgctgcggtgatcctcgaaccgattcagggcgaaggtggcgtaattctgccgccgccaggctatctcaccgccgtgcgtaagctgtgcgatgagttcggcgcactgatgatcctcgatgaagtacaaacgggcatggggcgcacgggcaagatgttcgcctgcgagcatgagaacgtacagccggatatcctttgtctggcaaaagccctcggcggcggcgtgatgccgattggcgcaaccatcgccactgaagaggtattctctgtcctgttcgacaatccgttcctgcacactaccacctttggcggcaacccgctggcctgtgcggcggcgctggcgaccatcaatgtgttgctggagcagaacttaccggctcaggctgaacaaaaaggcgatatgttgctggacggttttcgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacactcaacaacgctaaaacgatccgcattgaaccgccactgacactgaccattgaacagtgtgaactggtgatcaaagcggcgcgtaaggcgctggcggccatgcgagtcagtgtcgaagaagcgtaatatcaaatcggatggcgatacgacgtcgccatccgatctttttatacgatacgtacgcccgcaggcatcatccgctccggcgttaacagcacgctttcactgccgtcatcggtttccgcacacaacagcatgcattccgacgtttcaccgcgcattttcgctttttgcagattgcataagaccaccactgtttttcccatcagctcttcttcgctgtagtacggcaccagactggtcacggtttgcagagttttttcccccacatcaacctgtacgatgtacagcttgtcggcgttttcatggcgtttcacttccacaatctttccgacgcgcatttccagacgtgcaaaatcagcgtaagccacggtttccattgcttcctcctttcgagtaaaattttactaaactatagcaaaaatttttctcaatcctgtaggctaaaaatggagaatgcaggcgtgatcacattcgcaagccgctgtgttaccgttacagcgtcaaagaaacgcgctttatttactgaaaacaggtgacccgataagcacttcctctacaatgggggcgcacatcagggaaagtaaaaaaggtaaacatggcaacactaaaagacatcgcaatcgaagctggcgtatccctggcgacagtatccagggtcttgaatgacgatccgacattgaatgtgaaagaagagacgaaacatcgcattctcgagatcgccgaaaagctggagtacaagaccagtagcgcccgtaaactccagacaggcgcagtcaaccaacaccatattctggctatctacagctaccaacaggagctggagatcaacgatccttactatctggcgatccgccacggcattgaaactcagtgcgaaaagctggcgatcgaactgaccaactgttatgaacacaacggcttaccagacattaaaaacgtcaccggtattttaattgtcggcaaacccacgtccgccctgcgcgccgccgcctgtgcgttgaccgacaatatctgttttatcgactttcacgaacccggcagcggttacgatgcggtggatatcgatctggcacgtatcagtaaagaaatcatcgatttctatatcaatcagggcgttaatcgtattggttttattggcggtgaagacttacccggcaaggcggatattcgtgaggtcgcctttgcggaatatggtcgtctgaaacacgtggtacgcgaagaggatatctggcgcggcggtttttccagttcgtcgggctatgaactggcaaaacagatgctggcgcgggaagactatccgaaggcactgtttgttgcttccgattccattgctatcggcgtactgcgggcaattcatgaacgtggcctgaacatcccacaggatatttcgcttatcagcgttaacgatatccccaccgcgcgatttacctttccgccgctctccaccgtgcgcatccattccgaaatgatgggaagtcagggcgttaacctagtgtatgaaaaagcccgcgatggtcgcgcgctgccgctgttggtcttcgttcccagcaaattaaaactgcgcggcacgacccgttaaatccccttgcacgctgtccggcaatcgtttttgccggacagtgctgccgtttattttcgtgatccagttaaagtaaatgcatttatccgctactttttagtaaaatttttactaaactccccagcaattacacaaactaccatcaccatgaatggttccgatttctctctaccgggaggccctatgaatcgctgggaaaacattcagctcacccacgaaaaccgacttgcgccgcgtgcgtactttttttcatatgattctgttgcgcaggctcgtacttttgcccgtgaaaccagcagcctgtttctgctcttaagcggtcagtggaatttccacttttttgaccatccgctgcaagtgccagaagccttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctacgttaacggtcagtatgtggggttcagcaagggcagtcgcctgaccgcagagtttgacatcagcgcgatggttaaaaccggcgacaacctgttgtgtgtgcgtgtgatgcaatgggcggactctacctacgtggaagaccaggatatgtggtggtcggcggggattttccgcgatgtttatctgatcggaaaacaactcacgcatattaacgatttcaccgttcgtaccgactttgacgaagcctattgcgatgccacactttcctgcgaagtggtgctggaaaatctcgccgcctcccctgtcgtcacgacgctggaatataccctgtttgatggcgaacacgtggtgcacagcagcgccattgatcatttggcaattgaaaaactgaccagcgccagttttgcttttactgtcgaacagccgcagcaatggtcagcagaatccccttatctttaccatctggtcatgacgctgaaagacgccgacggcaacgttctggaagtggtgccacaacgcgttggcttccgtgatatcaaagtgcgcgacggtctgttctggatcaataaccgttatgtgatgctgcatggcgtcaaccgccacgacaacgatcatcgcaaaggccgcgccgttgggatggatcgcgtcgagaaagatctccagttgatgaagcagcacaacatcaactccgtgcgtaccgctcactacccgaacgatccacgtttttacgaactgtgcgatatctacggcctgtttgtgatggcggaaaccgacgtcgaatcgcacggctttgctaatgtcggcgatatcagccgtattaccgacgatccgcagtgggaaaaagtctacgtcgagcgcattgttcgccatattcacgcgcagaaaaaccatccgtcgatcatcatctggtcgctgggcaatgaatccggctatggctgtaacatccgcgcgatgtaccatgcggcgaaggcgctggatgacacgcgactggtgcattacgaagaagatcgcgatgctgaagtggtcgatattatttccaccatgtacacccgcgtgcctctgatgaatgagtttggtgaatacccgcatccgaagccgcgcatcatctgtgaatatgctcatgcgatggggaacggaccgggcgggctgacggagtaccagaacgtcttctataagcacgattgcattcagggacattatgtctgggaatggtgcgaccacgggatccaggcgcaggatgacaacggcaacgtctggtacaaattcggcggcgactacggcgactatcccaacaactataacttctgtcttgatggtttgatctattccgatcagacgccgggaccaggcctgaaagagtacaaacaggttattgcgccggtaaaaatccacgcgctggatctgactcgcggcgagttgaaagtcgaaaataaactgtggtttaccacgcttgatgactacaccctgcacgcagaggtgcgcgccgaaggtgaaacgctcgcgacgcaacagattaaactgcgcgacgttgcgccgaacagcgaagcccccttacagatcacgctgccgcagctggacgcccgcgaagcgttcctcaacattacggtgaccaaagattcccgcacccgctacagcgaagccgggcattctatcgccacttatcagttcccgctgaaggaaaacaccgcgcagcctgtacctttcgcaccgaataacgcccgtccgctgacgctggaagacgatcgtttgagctgtactgttcgcggctacaactttgcgatcaccttctcaaaaacgagtggtaaaccgacatcctggcaagtgaatggcgagtcgctgctgacccgcgagccaaagatcaacttcttcaagccgatgatcgacaaccataagcaggagtacgaagggctgtggcagccaaatcatttgcagatcatgcaggagcatctgcgcgattttgtcgttgagcaaagtgatgatgaagtgttgctagtcagccgcacggttattgccccaccggtgtttgacttcgggatgcgctgcacctacatctggcgcatcgctgccgatggccaggttaatgtggcgctttccggtgaacgttatggcgactatccgcacatcattccgtgcatcggtttcaccatgggaattaacggcgaatacgaccaggtggcgtattacggacgtggaccgggcgaaaactacgccgacagccagcaggctaacatcattgatatctggcgcagtaccgtcgatgccatgttcgagaactatcccttcccgcagaacaacggcaaccgtcagcatgtccgctggacggcactgactaatcgccacggcaacggtctgctggtggttccgcagcgaccaattaacttcagcgcctggcactatacccaggaaaacatccacgctgcacagcactgtaacgagcttcagcgcagtgatgacatcaccctgaatctcgaccaccagttgcttggcctcggctctaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacgaatttgcacagcgagaataagcaatgaggatcatcgataacttagaacagttccgccagatttacgcctctggcaagaagtggcaacgctgcgttgaagcgattgaaaatatcgacaacattcagcctggcgtcgcccactccatcggtgactcattgacttaccgcgtggagacggactccgcgaccgatgcgctatttaccgggcatcgacgctattttgaagtgcattactacctgcaagggcagcaaaaaattgaatatgcgccgaaagagacattacaggtagtggaatattatcgtgatgaaactgaccgtgaatatttaaaaggctgcggagaaaccgtagaggtccacgaagggcaaatcgttatttgcgatatccatgaagcgtatcggtttatctgcaataacgcggtcaaaaaagtggttctcaaagtcaccatcgaagatggttatttccataacaaataacaactacggcggcaaaaggagtttgccgccactgctaccctactcattttcggagatgtgttatgtctgataccaaacgtaatacaatcggcaaattcggcttgctctcgctgacttttgccgccgtttacagctttaacaacgttatcaataataatattgagcttggactggcctcggcaccgatgtttttcctcgcgacgattttttattttattcccttctgtctgatcattgcagaatttgtttcgttaaataaaaactcagaagccggtgtctacgcgtgggtaaaaagttcgctgggcggacgttgggcatttattactgcctatacctactggttcgtaaacctgttctttttcacctcgctgttaccgcgcgttattgcttatgcttcgtatgccttcctcggctacgaatatattatgacgccggttgccaccaccattatcagtatggtgctgttcgccttctccacctgggtttctaccaatggggcgaaaatgctggggccaattacctccgtcacttcaacgctgatgctgctgttaacgctctcctacattttactggcaggtacggcactggttggcggcgtacagcctgctgaccccatcactgttgacgcgatgatcccgaacttcaactgggcgttcctcggcgtgaccacctggatctttatggccgcaggtggcgcggagtccgtcgcggtgtacgttaacgacgtcaaaggcggttcgaaatcgttcgttaaagtgatcatcctcgccgggatttttatcggcgtactgtattccgtctcctcggtgctgattaacgtcttcgtcagcagcaaagagttgaaatttactggcggatcggtgcaggtattccacggcatggcggcgtattttggtctaccggaagcgttgatgaatcgctttgtcggtctggtgtcctttaccgcgatgttcggttccctgctgatgtggacggcaacgccggtgaaaattttcttctccgaaatcccggaaggcatctttggtaagaaaaccgtcgaactgaacgaaaacggcgttccggcgcgcgcagcgtggatccagttcctgatcgtcatcccgctgatgattatcccgatgctcggttccaataccgtgcaggatctgatgaatactattattaatatgactgccgcagcgtccatgcttccgccgttattcatcatgctggcttacctgaatttacgcgccaaattagatcacctgccacgcgatttccgtatgggctcccgccgcaccggtattatcgttgtttcaatgctgattgcgatatttgccgtagggtttgtcgcttcgacattcccgactggcgcgaatattctgaccatcattttttataacgtcggcggtattgttatcttcctcggctttgcgtggtggaaatacagtaaatatataaagggattaacggctgaagagcgccatattgaagcgacgccagccagaaatgttgattaagcaaaataataaaaaatgagcaggcattttccctcttcctggatggggagagggaaaatagtttctgcctttatatttttataattacaacgataaaaggctgtactttttctttagctcatggattaacacaatgaaattaatcactgcaccatgcagagcattacttgcgctgccgttttgctacgccttttctgtgaccgctgatgaagcacgtccggcagaacatgacgacacaaaaacccccgcaatgacctcgacatcttctccttcatttcgtttttacggcgaattaggggttggtgggtatatggatttagagggtgagaataaacataaatacagcgacggcacctatattgaaggtggcctggagatgaagtacggctcctggttcggcctgatttacggcgaaggctggaccgtgcaggccgaccacgacggtaatgcctgggtgcctgaccatagctggggtggtttcgaaggtgggattaaccgtttctatggcggttatcgtaccaatgatggcaccgaaatcatgctcagtctgcgtcaggattcctcgctggatgacctgcaatggtggggcgatttcacgcccgatctgggctacgtcattcccaatacccgcgacattatgactgcgctgaaggtacagaacttaagcggcaactttcgttatagcgttaccgccacacctgccggacatcatgacgaaagcaaagcctggctacattttggcaagtacgatcgctacgacgacaaatacacctatccggcaatgatgaacggttacatccagtatgaccttgcagaaggtatcacctggatgaacggtctggaaatcaccgacggcacaggccaactctatctcacgggcctgcttacccctaactttgccgctcgcgcctggcaccataccggacgcgccgacgggctggacgtatcgggaagtgaaagcgggatgatggtgagcgccatgtatgaagcgttaaagggcgtttatctctccaccgcttacacctacgccaaacatcgccctgaccacgctgacgatgaaaccacctctttcatgcagtttggtatctggtacgaatacggcggcggacgtttcgcaacggcttttgatagccgcttctacatgaaaaatgcctctcacgatcccagcgaccaactcttcctgatgcaatatttttactggtaataaggacagtaatctcatgaaaataaaaaccattttaacgccagtagcctgtgctctgctgatgagcttttccgcccatgccgctaacgctgacaattataaaaacgtgattaaccgtactggcgcgccgcagtacatgaaggattacgattacgacgatcaccagcgttttaatccgtttttcgatctcggagcctggcatggtcatctgttgccagacggcccgaacactatgggcggctttcctggcgttgcgctgctgacggaagaatacatcaactttatggccagcaatttcgatcgcctgaccgtctggcaagacggcaagaaagtcgatttcacgctggaggcatacagtattcccggcgcgctggtgcaaaagttgatatcgaaagatgtacaggtcgaaatgattctgcgcttcgccacgccgcgcacatcactactggaaaccaaaatcaccagcgataaaccgctggatctggtgtgggatggcgaactgctggaaaaactggaagcgaaagaagggaaaccgctttccgataaaaccattgctggcgaataccctgactatcagcgcaaaatcagcgccacccgtgatggcctgaaagtcacctttggcaaagtgcgcgccacctgggatctgctgacctccggtgaatcagaatatcaggtgcataaatccctgccagtgcagactgaaatcaacggcaatcgctttaccagtaaggcgcatatcaacggttcgacgacgctctataccacctactcccatctgctgaccgctcaggaagttagcaaagagcaaatgcagatccgcgatattctggcgcgtccggcgttttatctcaccgcctcgcagcaacgctgggaagagtatctgaagaaagggttaaccaatccggatgcgacgccggaacagacgcgcgtcgcggtgaaagccatcgaaacgctcaacggtaactggcgatcgccgggcggtgcggtgaaatataacaccgtcacgccgtcggtgaccgggcgctggttctccggcaatcagacctggccgtgggatacctggaagcaggcgtttgcgatggcgcatttcaatccggatatcgccaaagagaatatccgcgcggtcttctcctggcagatccagccaggcgacagcgtgcgtccgcaggatgtgggctttgtccccgacctgattgcgtggaaccttagccccgagcgtggcggcgatggcggcaactggaacgaacgcaataccaagcccagccttgccgcctggtcggtgatggaagtgtacaacgtcacccaggataaaacctggctggcagagatgtacccgaaactggtggcctatcacgactggtggttacgtaaccgcgatcataacggcaacggcgtgccggaatatggcgcgacccgcgacaaagcccacaacaccgagagcggcgagatgctgtttacggtgaaaaaaggcgacaaagaagagacgcggtctgggctgaacaactacgcccgcgtggtggagaaaggccagtacgacagtctggaaattccggcacaggttgccgcgtcgtgggaatcgggtcgtgatgatgccgccgtttttgggtttatcgacaaggaacagttggataaatatgtcgctaacggcggcaaacgtagcgactggacggtgaaattcgccgagaaccgcagtcaggacggaacgttgctgggctactcgctattgcaggagtcggtggatcaggccagctatatgtacagcgataaccattatctggcggagatggcgacgattctcggtaagccggaagaggccaaacgctatcgtcagttagcacaacagctcgcggactacatcaacacttgtatgttcgacccgactacacagttctactatgacgtgcgtattgaagataaaccgctggcgaacggctgcgcgggcaaaccgattgttgagcgcggtaaagggccagaaggctggtcgccgctgtttaacggtgcggcaacgcaggccaacgccgacgcggtggtgaaggtgatgctcgatcctaaagagttcaacacctttgtaccgctgggaacggcagcgttaaccaacccggcttttggcgctgatatctactggcgcgggcgcgtatgggtagatcagttctggtttggtctgaaaggaatggagcgttacggttatcgtgatgatgccctgaaactggcggatacgttcttccagcatgccaaaggattaaccgccgatggcccaattcaggagaattacaacccgctgactggcgcacagcaaggcgcaccaaatttctcctggagtgccgcgcatttgtatatgttgtataacgattttttccgtaagcagtaatttttcccgatgccggacgactgtattaccgccgtccggcatgacgaacgggcgtattctttttgaatcccatcacaaaccccgcactccccttttcccttttctccggcgacggctaaattagaactcatccgaccacataacaattattttacatactggacaattttatgagctatccgtcgctgtttgccccgctggatttaggttttaccacgttaaaaaaccgcgtgttgatgggctcaatgcacaccgggctggaggaatacccggacggcgctgaacggctggcagcgttttatgccgaacgcgcccgtcacggcgtggcgttgattgtcagcggcggtatcgcaccagatttaacaggcgttggcatggaaggcggtgcaatgctcaatgacgccaaccagatcccacaccatcgcaccattaccgaagccgtacatcaggaaggcggcaaaatcgccctgcaaattttgcataccgggcgctacagctaccaaccgcatctggtcgcaccctccgcattgcaggcccccatcaaccgtttcgttcctcacgaactcacccatgaagagatcctgcaactgatcgacgatttcgcccactgcgcgcaattggcacgggaggcaggatacgacggtgtagaggtgatggggtccgaagggtatttgatcaacgaatttctgacgctgcgcaccaatcagcgtagtgaccagtggggcggcgattaccgcaaccggatgcggtttgccgtagaagtagtgggtgcggtgcgcgaacgtgtcggcaacgacttcattattatctaccgtttgtcgatgctcgacctggtcgaaggcggcggtacttttgccgaaacggtagagctggcgcaggccattgaagcggcgggcgcaacgattatcaacaccggcattggctggcatgaagcacgtattccgaccattgccacgcccgtgccgcgcggcgcatttagctgggtcacgcgcaaactgaaaggccacgtttcgctgccgctggtgaccaccaaccggattaacgatccgcaggttgccgacgacattctctcgcgcggtgatgcggacatggtatcgatggcgcgaccgtttctcgctgatgcggagctgctgtcaaaagcgcaatcgggacgagccgatgagatcaacacttgtattggctgcaaccaggcctgtctcgatcagatcttcgttggcaaagtcacctcgtgcctggtgaatcctcgcgcctgccatgaaaccaaaatgccaatccttccggccgtgcagaaaaaaaatctggcggtggtcggtgcgggacctgctgggctggcgtttgccattaacgcggcggcgcgtgggcatcaggtaacattgtttgatgcgcacagcgagatcggcgggcagtttaatatcgccaaacagatccccggcaaagaggagttttacgaaacgctgcgctattaccgccggatgatcgaagtgacgggtgtgacactgaaacttaatcacaccgtgaccgcagatcagttaaaggcgttcgatgaaacgatcctcgccagtgggatcgtaccgcgcattccgcccatcgacgggatcgatcatccgaaggtgttgagttatctcgacgtactgcgcgacaaagcgcaggtaggcaacaaagttgccatcatcggttgtggcgggattggttttgatacggcgatgtatttaagtcagccgggcgaatccaccagccagaatatcgccgggttctgtaatgaatgggggatcgacagcagcctgcaacaggctggtggcttaagcccgcagggaatgcagatcccgcgtagcccacggcagattgtgatgctccagcgcaaagccagcaaaccgggacaggggttaggcaaaaccaccggctggatccatcgcaccaccctgctctcgcgcggtgtgaaaatgatcccaggcgtaagttatcagaagattgacgatgacgggctgcatgtggtgatcaacggcgaaacgcaggtattagcagtggacaatgtggtgatctgcgcagggcaagagccaaaccgcgcattggcgcaaccgctgattgatagcgggaaaactgtgcatttaattggcggctgcgatgtagctatggagctggacgcacgacgggcaattgcccagggaacacggctggcgctggagatttaaattgtgcattgaagtgccggatgcgacgcttgccgcgtcttatccgacctgggggtaatgtgctgaacgtatgccagataaggcgtttacgccttatctggcaggtagctgccaatcttaccgacgacgccccagcttcactgctttcagcaccacaaatttattattcgtggcgatggtggtgcagttgccgaaaatcttcttcagtttatggaagtaatccaggtgacggttggcaacgatatacagctcgccgttgattttcaggcagcggcgggcatggtggaacatctcccaggcgacgttatcggtcagcgcatgttgctgatgaaacggcgggttgcagagcacagcattaaaacggaaaggctccacgccggagagcgcgttgttgatcataaactcgcagcgatccaacgcctcgggcatgttggtttcaacgttcaaacggctggaagcaaccgccatcggcgattcatcgacaaacaccactttcgcctgcgggtttttatcaagcagcgtcagaccaataacgccattaccgcagccgagatcgacaatctcaccctcgagattctctggcagatgttgcataaagaagcgcgcgccaatatccagcccggtgcgggagaagacattcgcatggttgtggatagtccagtcagtaccttccagtttccagctaacggtctgcggcgcatcggccagcggcggctcgttgaaagtacagttaattaagcgtgccttcttccatgccagcgtggtggtagtcgggccgagcactttttcgaacagttccagcgtggaagtgtggatgtcacgggctttggcaccggcaataatacgtgtatccggcgtgaccactttgcgcagcgcacgcagttgttgttccagcaatgccagtgttttcggtactttgatcagtaccacgcccggctgttgcgggtagtcggcggtgctgtcgagaaacttcacgctcgattcatcaatcccgttgaggcgtaaattctcgcgcgtggccagttcactgatgtatgagtcgccaatgctgtacggcttatgttccgccagcgcacaacttaacgcaccaaaggcatcattcaggatcaacaccgggccgcggatttctgtgtcgtccaactgttgcagcaaatattcatccgccgcttcccacgcctgtagcgggttaacgtcatccgtcgccggaaaacgttgtagtgtcagtgaacggaaaccgttgtctaagtggctcatcggccctcctgaatgataaaatttcgacgttgcccctgaaaagggtgcgtgagtataccctttttctctttttcgtgggcggttatgagcaatcttacttatcttcagggttatcccgagcagctactttcccaggtgcgaacgctgattaacgaacagcgtctgggcgatgtgctggcaaaacgttatccgggaacacacgactacgccaccgataaagccctctggcaatatacccaggatcttaaaaatcagtttctgcgcaatgccccgccgatcaataaagtgatgtatgacaataagatccacgtgctgaaaaacgcgctcggattacatactgccgtttcgcgtgtgcagggcggcaagctgaaagcaaaagcagagatccgcgtcgctaccgtgtttcgcaacgcgccggaaccgtttttgcgcatgatcgtggtgcacgagctggcgcacctgaaggagaaagagcataacaaagcgttttaccagttgtgctgccatatggagccgcagtaccaccagcttgagttcgacacccggctgtggctaacgcagttgtcgcttgggcaggacaaaatctgaaaatgatgtcaggcgttattttttcctcctttagcgcctaaaatcgacctcccccctttcgttaaggataacgaccatgctgcgcgcctttgcccgccttcttctccgtatttgtttttctcgccggactctaaagcttggctgtttattgttgcttatagcaggagcgaccatttttattgccgatcgcgttatggtcaacgccagcaagcagctgacctggagcgatgtcaacgccgttccggcgcggaacgtgggtttattgctgggggcgaggccgggtaatcgctactttacccgacgtattgataccgcagcagcgttgtaccacgccggaaaagtgaaatggctattggtgagcggcgataatggacgtaaaaattacgatgaagcgtcaggaatgcagcaagccttgatcgctaaaggcgtaccggcaaaagtgatcttctgcgactatgccggattctcaacgcttgattcggtggtgcgtgccaacaaggtgtttagtgaaaatcatatcaccattatctcgcaagaatttcataaccaacgcgccatctggctggcaaaacagtatggtatcgatgctatcggttttaacgcgccagacctcaatatgaagcacggtttatatactcaactgcgggaaaaacttgccagagtcagcgcggtgattgatgcgaaaatcctccatcgccagccgaaatatctcgggccgttggttatgattgggccgtttagtgagcatggctgtccggcgaaagaataatgcgtatctgcgcacgtcgaagataaaaaaggcgtgctacagtgacgagagaatccctttatggagtatccacgcgttatgatacgtttcgctgtgattggtacgaactggatcactcgccagttcgtcgaggccgcccatgagagcggtaaatacaagttaaccgccgtttattcccgcagtcttgaacaggcccagcacttcgccaatgatttttctgtcgagcatctgtttacgtcgctggaagcgatggcagaaagcgatgccattgacgcggtgtatattgccagcccgaattccctgcacttttcccagacacaacttttccttagtcacaaaattcatgtgatttgcgagaaaccgctggcgtcaaatctggcggaagtggatgccgccattgcctgtgcgcgggaaaatcaggtggtgctgtttgaggcatttaaaacggcctacctgccgaactttcatttgctgcgccaggcgctgccgaaagtcggcaaactgcgtaaagtctttttcaactattgccagtattcctcgcggtatcagcgttacctggacggagagaatcccaacacctttaatccgacattctctaacggttcaattatggatatcggcttttactgcctggcgtcggcggtggcattattcggtgaaccgaaaagcgtgcaggcaaccgccagtttgctggcaagcggtgtggatgcccacggcgtggtggtgatggattacggtgatttcagcgttacgttgcagcactcaaaagtgagcgattctgtcctggcaagcgagattcagggcgaagcgggatcgctggtgattgaaaaactgtctgaatgccaggaagtttgctttgtaccgcgtggcagccagatgcaggatctcacccagccacagcatattaataccatgctctacgaagcagagctgttcgctaccctggtggatgagcatctggtgaatcatccagggctggcggtcagtcgtatcaccgccaaactgctgactgagatccgccgccagactggggtgatttttccggcagataacgtaaaactataattgccaaagtaaaacagtgtaaaaggtatgtaacagaccattgactgactgaatggtctgtcatactttgttacctgcaaaggggagtaacttcattgtcggtcgatcgtcattacgatgtgtgaaaaaccacatccggtcaccgggcaacccgaaaggaatacgcagacgtattccttttttgttgtaagtgagaccttgccggaaggcgaggtctatgcataaaaagcagcggctgatgtcttccgacgttggccgtttttttatgtgtaaggaacttctatgaatactgtcggcacgccgttgctatggggcggattcgctgttgttgtcaccattatgctggctatcgacctgttgttgcaggggcgtcgtggggcacatgccatgaccatgaaacaggctgcggcctggtcgctggtctgggtgacgctgtcgttactgtttaacgccgctttctggtggtatctggtgcaaaccgaaggtcgcgccgttgccgatccacaggcactggcctttctcacgggttatctgattgagaaatcgctggcggtcgataacgtctttgtctggctgatgttgttcagctatttctctgttccggcggcattacaacgccgcgtgctggtgtatggcgtactcggggcgattgttctgcgtaccatcatgatcttcactggtagctggctgatttcacagttcgactggatcttgtatatcttcggtgccttcctgctgtttaccggcgtgaagatggcgctcgcccatgaagatgaatcaggcattggcgacaagccgctggtgcgctggctacgcggtcatttgcgcatgaccgacaccatcgacaacgagcatttctttgtgcgtaagaatggtttgttgtatgccacgccgctgatgctggtgctgattctggtggagttgagcgacgtgattttcgccgtggatagtattccggctatcttcgccgtgaccaccgatccgtttattgtgctgacctcaaacctgtttgcgatcctcggcctgcgtgcgatgtatttcctgctggcaggtgtggcagagcgtttctcgatgctcaaatatggtctggcggtgattctggtgtttatcggtatcaagatgctgattgtcgacttctaccatattccgatcgctgtctcgctgggcgtggtgtttggcattctggtgatgacgtttattatcaacgcctgggtgaattatcggcatgataagcagcgggtagaataatttttaatctgcctaagccgtgtactctgtcatcaacatgagcaccgttttctccctctccccaaaaggggcgaggggactgaccgagtacttttttgacgttgtcatcagtctggaagccgcacgttgggctttattttcatgtcaaacaaatgtaaccattaagttgcgaaatatgacttctctttaaaatccagcatatttcgcttcccgaagctgtaactttccttatactcgaccttgcaaacactttgttacatcctgaaagatgcgtcgacagaacgcaccagggatgtgcgacaacacaatgaaaggatcgaaaaatgactacgcaacattcaccggggctattccggcgtctggctcatggcagcctggtaaaacaaatcctggccggccttattctggggattcttctggcatggatctcaaaacccgcggcggaagctgttggtctgttaggtactttgttcgtcggcgcactgaaagccgttgcccccatcctggtgttgatgctggtaatggcatctattgctaaccaccagcacgggcagaaaaccaatatccgccctattttgttcctctatctgctgggcaccttctctgctgctctggccgcagtaatcttcagttttgccttcccttctaccctgcacttgtccagtagcgcgggtgatatttcgccgccgtcaggcattgtagaagtgatgcgcgggctggtaatgagcatggtttccaaccccattgacgcgctgctgaaaggtaactatatcgggatcctggtgtgggcaattggcctcggtttcgcactgcgtcacggtaacgaaaccaccaaaaacctggtcaacgatatgtcgaatgccgttacctttatggtgaaactggtgattcacttcgcaccgatcggtatttttggtctggtttcttctaccctggcaaccaccggtttctccacgctgtggggctacgcgcaactgctggtggtactggttggctgtatgctgctggtggcgctggtggttaacccactgctggtatggtggaaaattcgtcgtaacccgttcccgctggtgctgctgtgcctgcgcgaaagcggcgtgtatgccttcttcacccgcagctctgcggcgaacattccggtgaatatggcgctgtgtgaaaagctgaatctggatcgcgatacctattccgtttctattccgctgggagccaccatcaatatggcgggcgcagcaatcaccattaccgtgttgacgctggctgcggttaatacgctgggtattccggttgatctgcccacagcgctgctgttgagcgtagtggcttctctgtgtgcctgtggcgcatccggcgtggcgggggggtctctgttgctgatcccactggcctgtaatatgttcggtatttcgaacgatatcgccatgcaggtggttgctgtcggctttattatcggcgtattgcaggactcctgtgaaaccgcgctgaactcgtcaactgacgtgctgttcactgcggcagcttgccaggcggaagacgatcgtctggcaaatagcgccctgcgtaactaatacttagcccctttcgtctacggcggaaggggttttctccactttaaacggatcaattccccttctctgcatacgccagaaacgaatgatattcaggccattcatcagcagaaaactgccttcaatcatcgtgccgcctatcgaccccgcccagaagttgtgaatcacccagcaacacgttgaaaaccacattacgcagcgcatggtcagccctttacagcggaacagcgcccaggtactgacaatcgtgccgattaccggcaatagttcgacaggatgatggaacttcgcgaggccaattccgccagtcagcacaataaaaatcgccattacccataagctgcgcgtgcgtaaggtaatcaatgtacgaatggcattaaggatggcactggcaccggcaggataggtgcccagaagaaaaaaatgtacgccaataacggcgctatagaccgaaagttgctttttgaagcgacgttcgtcacgattgaaaaatgttgtgataccaatcagaaaggcgatgacacccacgccctgggccagccaatacgcggtcatgataaatccttagcaggtatggaaaagcaaacggcgcttcacattatgaaacgccgttttttattaacaactcatttcgactttatagcgttacgccgcttttgaagatcgccagttcgcggaagtcgttacgctcgttgcaggtttgtttaccattggcaaactcaacgatggtgtcgataaattcttccagcaactgcggcatcgctttaccgtggatcagctgacccgcgtcaaagtcgatccagtgttttttcttcgccgccagttcactgttggtggcgattttcaccgtcggcacaaatccaccatacggcgtaccacgaccagtactgaacagcaccatatggcagcccgcacccgccagggcgctggtcgctacggcatcgttacccggcgcacttaacaagttcagccccggcgttttcagacgctcgccgtaacgcagcacgtcaaccacgacactggtacccgctttctgggtacagccaagtgatttgtcttccagcgtggtgataccgcctgctttgttccccggtgatgggttttcgtagatcggctggtcatgggcaataaagtactgcttgaagtcattgaccatggtgaccagtttttcaaacgttgcttcgtcgcgacaatggtccatcagcaactgctctgcgccaaacatctccggcacttcggtcagtacggtagtaccgccgttagcaatcacgtagtcagagaaacgccccagcatcgggttagcagtaataccagaaagaccgtcagaaccaccgcactccagaccaaacttcagttcgctgagtttgcccggctcgcgtttatcgttgcgcatcacgctatacagctgatgcaaatgcgcgatcccggcctcgatttcatcatcctgctgttggcagatcatgaaatgaacgcgttcaggatcgatatcgcccaacgtttcacggaatgcggcaacctggttgttttcacagcccagaccaatcaccagcactgcgcccgcgttcgggtggcgcaccatgttttgcagcatggtgcgagtattgatgtgatcgtcgcccagttgtgagcagccgtaggtgtggctgaagaggaacacgccgtcggtaccttcagcgttgttggtctctttcaggaaacgattttggatctgccgcgcgatgccgttgacacagcccacggttggcaggatccacagctcattacgcaccccgacatcgccgttagcgcgacgatagatctgcacttcacgatctgccgcttgcgcaggcagatcctgaaaatcaggttgatagcgatactgatccagatcgctcagattcgtgcgcgtattgtgggcgtgaacgtgttcccccgctgcaatatccgccaatgcataaccaatcggcaggccatatttaatgacgttggccccttttgcgatatccgttaacgcaaatttatgtccacgagcaacatcctggcgcagcgtaacagtctggttatcgacactgacttctgtgccttcagccaaatccgctaaagcaaccgcgacgttatccagcgcatggatcttgatgtattgcatatcaaccccagaccttagttcagttcaatggcgaagtagtcacgcgcattgttaaagcaaatatttttcaccatctcgcccagcaggttgatgtccgccggtgcttcgcctgcttccacccagcgaccgatcatttggcacagaatgcggcggaagtattcgtgacgggtgtatgacaggaagctacggctgtcagtcagcatgccgacaaagcggctcagcagaccgagctgcgccagttgggtcatctgacgttccataccgtctttctggtcgttaaaccaccagccggaaccgaactgcattttgcccggcataccttcgccctggaagttaccgatcatggtgcccagcacttcgttatcgcgcgggttcaggcagtagagaatggttttcggcagcaggttttcttcattctgcttgctcagcagcttagacagctcttccgccatcggacggtcgttgatggagtcaaagccgacatccggccccagcagtttaaactgacgcaggttgttattacgcagtgcgccaatgtggtactgctgtacccagccgcgacgtgcatattcggcaccaaggaacaccagcaccgcagttttgaactgtgccacttcgtgctcgctcagggtttcgcctgccagacggcgcgcgaggatgctgtccagttccgcttcgttcgcttcagcaaacatcaccacatccagcgcgtggtcagacactttacagccgtgagcggcgaagtgatccagacgtttagtcagggcagtttgcaggtcagcaaagcggcgaatgtcggtatcggaaacttcgcccagcttcgccatgtagtcgttaaaggtcgcctgttcaatgttaaaggctttgtccggacgccagctcggcagcactttaatggtgaaagagccgtctttggcgatctctgcgtgatgctccagagaatcgatcgggtcatcggtggtgccgaccattttcacgttcatctgctgcatgatgccgcgtgcagagaaattatcctgcgccagcagttcgttacattcgttccagatttcatcggcagttgacggagaaagcaatttgccagtgataccaaacggacgacgcagttcgaggtgcgtccagtggtataacgggttgccgatagtgtgcggaacagtcgccgcccaggcgtcaaatttttcacggtcagacgcatcaccggtgcacagacgctcggccacaccgttggtacgcatagcgcgccatttgtagtgatcgcccttcaaccagatgtcatacaggtttttaaaacgatagtcttccgcaatctgctgcggcggcaaatggcaatggtaatcgaaaatcggctggtcttttgcgtagtcgtgatacagacggcgggcaaattcagtatctaacaggaaatcttcagtcataaacggagtcattttcgtcttcctctcaacgagtgagctagcttgcttatggtgcgatgctgacaaagttatcacaccaatttccagagtccgaagatattttcgtgagttagatcaataaacgtagttaaaaaaattactctcaaagtggtaaatctcgctgcaggccgcgccagtactggcctcgccgtcgtcaggtaatgtccctacaaatattcgcacatttgtgatggctctcaccttttaaagttgtatgacaagttatctttctgccgtcgcaaatcataagtcgacggaatgcaaattgccgattcattcatttgttagatgaatcgggttaaccggtacggaagccgaattagcacgaaactttcatggcaacgttcggggcgtgccggttttttttcggttacccggtcgtaactaacatcttcagcctctggcgggatgatggccgcgcttcctgcggatataacaaaacgatgaggttttacatgcgtaaaattaaagggttacgttggtatatgatcgcactggtgacgctcggcaccgtgcttggttacctgacgcgtaacactgtggcggcagctgcgccaactctgatggaagagttaaacatctccacccaacagtattcctatatcatcgcagcgtattctgctgcttatacggtcatgcaaccggtagcgggttatgtactggatgtgctgggtacgaaaatcggttatgcaatgtttgctgtactgtgggccgtgttctgtggtgcaactgcgctggcaggtagttggggtggcctggcggttgctcgtggtgcggtcggtgccgcggaagccgcgatgattccggcgggtctgaaagccagctccgaatggttcccggcgaaagagcgttccatcgcggtaggttactttaacgtaggttcttcgattggtgcgatgattgcgccgccgctggtggtatgggcaatcgtgatgcacagctggcagatggcatttatcatctccggtgcgttgagctttatctgggcgatggcatggctgattttctataaacatccgcgcgaccagaaacatctgaccgatgaagaacgcgactacattattaatggtcaggaagcccagcaccaggttgacacagcgaagaaaatgtccgttggtcagatcctgcgcaaccgtcagttctggggtatcgcgctgccgcgcttcctggcagaaccggcatggggtacttttaacgcgtggatcccgctgttcatgtttaaagtttacggctttaacctgaaagagatcgcgatgtttgcctggatgccgatgctgtttgctgacctcggttgtatcctcggtggttacctgccgccgctgttccagcgttggtttggtgtgaacctgatcgtttcccgtaagatggtcgtaacgctgggtgcggtgctgatgattggcccgggtatgatcggtctgttcaccaacccgtatgtcgcgattatgctgctgtgtatcggtggttttgctcaccaggcactgtctggcgcactgattacgctctcgtctgacgtgttcggtcgtaacgaagtggcgacggcgaacggtttaaccgggatgtccgcatggctggcaagtacgctgtttgcactggtagtcggtgcactggctgacaccatcggcttcagcccgctgttcgcagttctggcagtgttcgacctgttaggtgcgctggttatctggaccgtgttgcagaacaaaccggcgattgaggtggcgcaggaatcacataacgatcccgcaccgcaacattaaggcttcgtgtaagttttagtttcccttcaaagccgccttctcaggcggctttttcatcactgcgagtagagctaaactcgcaaaagtggtataacaaatatagtctgccgtatcatgcctggagcgcatatggaaatcactgaaccacgccgtttgtatcaacaacttgccgctgatctgaaagagcgcatcgaacagggcgtctatctggtgggtgataaactgcctgccgaacgctttattgccgatgaaaaaaacgtcagccgcaccgtggttcgtgaagccatcatcatgctggaagttgaaggctatgtcgaagtgcgtaaaggttcaggtattcatgtggtttccaaccagcctcgccatcagcaggcggctgacaataatatggaattcgccaattacggtccgtttgagttgctccaggctcgccagctcatcgaaagtaatattgccgagttcgcggcaactcaggtaacgaaacaggacatcatgaaattgatggccatccaggagcaggcgcgcggcgaacaatgcttccgtgattccgagtgggatttgcagttccatattcaggtagccctggcgacgcagaactccgccctggcggctatcgttgaaaaaatgtggacccagcgtagtcataacccgtactggaaaaaactgcacgaacacattgatgcccgtaccgtcgataactggtgtgatgaccacgatcaaatcctcaaggcgctgattcgcaaagatcctcatgctgctaagctggcaatgtggcagcacctggaaaacaccaagatcatgttatttaacgaaaccagcgacgatttcgagttcaatgccgaccgctatctgttcgccgaaaacccggtggtgcatctcgatacagccaccagcggcagtaaatgaaattcctgtccgacaggcgctacagtgcgcctgtttgtctcgtcggtaagcgaaaagtataaagtgtcagcctgtgtaaatcctctcgcctccctcccctgcattcagcaaaatcagactccacggacatgtaattttgataacgaacaacgttgacctttgttacaattagattcaatttgaatttatgcttttgaatgctttcttatctcacgatttaacagggaatagttcaggctgtgttgatgtatcaaacccgcagaacataccaagacagcaataacattgcggtagtgcatcatttaaaaccagcgtggcgttaaccgattcaccaggaataatgaatggaacttttgacccaattgctgcaagccctgtgggcgcaggattttgaaaccctggccaatccgtcgatgattggcatgttgtattttgtcttgtttgtcattttgttccttgaaaacggcttgcttccggcggcctttttaccgggcgacagtttactggtactggtcggcgtattgattgcgaaaggcgcgatgggctatccgcaaacgattctgctgctgaccgttgccgccagcctcggttgctgggtcagctatattcaggggcgatggctgggcaatacccgcaccgtacaaaactggctatctcatttacccgcgcattatcatcaacgcgcacaccatctttttcataaacacggtttatcggcgctgttaattggtcgctttattgcgtttgtcagaacactgctgccgacgattgccgggttatcagggctgaataacgcgcgctttcagttcttcaactggatgagtggtctgctgtgggtgttgatcctgacaactctgggttacatgctcggcaaaacgccggtatttttaaagtacgaggaccagctgatgtcatgcctgatgctgctcccggtggtgctgctggtgtttggcctggcaggttctctggtcgtgttatggaaaaagaaatatggaaatcgggggtaagggatgcaaatacctcgcatgtcacttcgccagctagcctggtccggcgctgttttacttctggtcagcacactattgctggcctggtccgcggttcgccagcaagagtctacgctggcgattcgtgccgttcatcaagggacaacgatgccagacggtttttcaatctggcatcaccttgacgctcacggcattcctttcaaaagtatcacccccaaaaacgacactctgttaattacctttgactccagcgaccagagcgccgccgcaaaagcggtcctcgacagaacattgccccatggctacatcattgcgcagcaggacaataacagtcaggctatgcagtggctgacccggttgcgggataactctcatcgcttcggataacttcctgttatccgaaacagatcactcactttggtgatttcaccgtaactgtctatgattaatgaggcggtggttaacactaccgcttcgttgtctggacaatcgttcctttgtaataggtccgaatcacaatggaaggttcaagaatgaaataccgcatcgctttagctgtttctctctttgctcttagtgccggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccagctgcgtgccgatcatcagaagaaaatcgcaaagcagaaagatgaggtggcggaacgccagcaagatttagccgaggcgaagcaaaaaggcgatgcagataagattgccaaacgcgaacggaaactggcagaagcgcaggaagagctgaaaaagctgaaagcgcgcgactactaactcacaatagtcactacttactcacctggagaaaactatgtcgaaagaacacactacggaacatctgcgtgctgagttgaaatccctttccgatacgctggaagaggtgcttagctcatctggcgagaagtcaaaagaagagttgagtaagattcgtagcaaagcggagcaggcactgaaacagagccgttatcgcctgggtgaaaccggtgatgccattgccaaacaaacccgtgtcgcggcggcgcgtgccgatgagtatgtgcgtgaaaatccgtggacgggcgtgggcattggcgcagcaatcggtgtagtgctcggcgttctgctgtcgcgtcgttaattatggcggacactcatcacgcgcaagggcccggtaaaagcgttctgggcatcgggcagcgaattgtttccatcatggttgaaatggtggagacacgtctgcggctggcggtggtggagctggaagaggaaaaagcgaatctctttcaacttttactgatgctgggcctgacgatgcttttcgctgcatttggtcttatgagcctgatggtgctagttatctgggcggttgatccgcaatatcgcctgaatgcgatgattgccaccaccgtggtgttgctgctactggcactgattggcggcatctggacgttacgtaaatcgcgtaagtctacgttgctgcgccacacgcgccatgagctggcaaacgatcggcagctgctcgaggaggagtcccgtgagcagtaaagtcgaacgtgaacgacgtaaggcgcaactgcttagccagatccagcaacaacggctggatctttccgccagtcgtcgtgaatggctggaggcaacaggcgcttacgatcgtcgctggaatatgctgttgagtctgcgctcctgggcgctggttggcagtagcgtgatggctatctggacgattcgccatcctaatatgctggtccgctgggccagacgcggttttggtgtatggagcgcctggcgtctggtgaaaacaaccctcaagcaacaacagcttcgcggttaacttcctctctggccggagaaattccggccttatccctcaaattttttgaaaatatttgacagttttccttgctaacaatcacgcttcgtcacgtttatgattctctccatcgacagcaacgacgctaatagcgcgcccttgcacaaaaaaacaatcagcagcctgagcggcgcagtggagagtatgatgaaaaaattagaagatgttggtgtactggtagcgcgtattttaatgccgattctgtttattacggcaggctggggaaaaattactggctacgcgggtacccaacaatatatggaagcaatgggcgtccccggctttatgctgccgctggtgattctgcttgagtttggtggtggtctggcaatcctgttcggtttcctgacacgtaccacagccctgtttactgcgggctttacgctgctgacggcatttttatttcacagcaactttgcagaaggcatgaactcgctgatgtttatgaaaaacctgactatttctggcggattcctgctgctggcaattaccggtccaggcgcattcagcatcgaccgcctgctgaataaaaagtggtaagcacgcgctatacttaacgataaaaaacgagggggaagctcctcgtttttgctattggaggatagaaaaatgggtcaactgattgacggcgtctggcatgacacctggtacgataccaaatccaccggcggtaaatttcaacgttcagcttccgcatttcgtaactggctcactgccgatggcgcgccaggccccactggcaaaggcggttttgccgcagagaaagatcgttatcatctctatgtttcactcgcctgcccgtgggcacaccgcacgctgatcatgcgtaagctcaaaggactggaaccgtttatttccgtttccgtagtgaacccgctgatgctggaaaacggctggacctttgatgacagttttccgggagcaaccggcgacacgctctatcaacatgaatttctgtatcagctttatctccacgccgatccacactacagcggacgagtgactgttcccgtgctgtgggacaaaaaaaaccacaccatcgtcagcaacgaatcagcagaaatcatacgcatgttcaataccgcgtttgatgcgctgggtgcgaaagctggagattactacccaccagccctgcaaccgaaaattgacgaacttaacggctggatttacgacaccgttaacaatggcgtgtataaagccggttttgccaccagccagcaagcctacgacgaggcggtggcgaaagtgtttgaatcgctggcgcgactggaacagattttaggtcagcaccgttacctgaccggcaaccagctaaccgaagccgatattcgcctgtggaccacgctggtgcgttttgatccagtgtatgtgacccacttcaagtgtgataagcaccgcatcagcgattacctgaatctgtatggcttcctgcgcgatatctaccagatgccgggaattgccgaaacagtcaatttcgatcacatccgtaatcattacttccgcagccataagaccatcaatcctacggggattatttcaattggtccgtggcaggatctcgatgaaccgcatggacgagatgttcgcttcggttaaaaaaaggcaccttacgaggtgcctctgataattagctaagtacgtgttgttcatatcggatgcggcgtaaacgccttatcaaacctacaaaacatttatattcaatatgttgcaatgaccgcgcaggccagataagcgtagcgcatctggcaattttgcgcttgcccttatccttcacagcgccttattaattcatcgcgataatatttactgccatttcattcacgtctattcttaatttgctgctttaaaaacaagtgattgagcaaaattgaggcaaaaatggactggtatctgaaagtactaaaaaattatgtcggtttccggggtcgtgcgcggcgcaaagagtactggatgtttattctggtcaacatcatctttacgttcgtgctggggctactggataaaatgttaggctggcaacgtgccggtggcgaaggcatcctgacgacaatctacggtattctggtgtttttaccatggtgggcagttcagttccgccgcctgcacgacaccgaccgctcggcgtggtgggcactgctattcttaatcccgttcatcggctggcttattatcatcgtctttaactgccaggcgggtacgccaggcgaaaaccgctttggaccagatccgaaactggaacaagaataataattaagcaccttgtaaaaggtgcttaatcgattattttccgctaaaaagtttgggaatttcccgcagacaccaggatttcgcctcccccatactgtcacgacgccaggccataataatatcgatctcgctggtcgattccgggctgacgacacgcaaccgcccttccgcaatatctttttcgaccatcggatacggcatcgtcgccacgccaagccccgccagtaatgcctgacgtttatcttcaatcgtgctcaccgttaagcgcggctgtttgtccagcaactgtacggtcaacaccgggcgctcacgagcggtatccgccaccgcaattccacgatatttcacgcgcgtcacttcagataacggttccggctcctgatgaatcgggtgatccggcgcggcaacataggcgttcattaaggtatagagtttgcgcgagttgatctccgacgaggaacgaaaatgcatatccggcgcgataacgatatccgcccgcccctgctccagccgttcccacgcccccgccagcacttcggtgatgattgccagttgggtattggcttttgccgccagtttgtcgattaacgggaaaaaggcaggtgtcggtaccagcgcctcggtcacaatggtgagatgcgtttcccaaccacgcgcgagggcttccgcatcggtagtcagtttatctgcggcttccagcaaaacgcgccctcgttccagcaacatcctcccgacattggtgaatttggtgcgatggcccgagcggtcaaacagcaccacatccagctcttcttccagtttttgcatggtgtagctaagtgcggaaggcacgcgtcccagctcatccgccgccgccgcaaaactgccccggcgatcgatcgcatccataacccgtagtgcttccagcgttaatgccctttctttggccatttcgttctcattcaggaaatttgaacataccgggcagaatatctggctaacaatgtagcgtccagccccttaccataaaaggaagtaaagagaggtcaagaattatgattactacccgaactgccaggcagtgtggacaagcagactacggatggttgcaggcccggtatactttttcctttggacactacttcgacccgaaattgttaggctatgcctccctgcgcgtgcttaaccaggaagtgctggccccaggtgccgcctttcagccgcgaacctatcccaaagtcgatattttaaatgtgattctggatggagaagctgagtatcgcgacagcgaaggcaatcatgttcaggccagcgctggtgaggcgttgctgctctctacccagccgggtgtcagctatagcgaacacaatctcagcaaagacaaatcgttaacgcgaatgcaactttggctggatgcctgcccacaacgagagaatccgctgattcaaaaactagcgcttaatatggacaagcagcaattaatcgcctcgccagaaggtgggatgggaagcctgcaattgcgccagcaagtatggctgcatcatattgtgctcgacaaaggcgaaagtgcgaatttccagttgcatgggccacgcgcgtatttgcaatcgattcacgggcaatttcatgcacttacgcatcatgaagagaaagcggcgctgacctgcggtgatggggcgtttattcgtgacgaggctaacattacgctggttgccgattccccactgcgcgctttgctgatagatttgcctgtctagttgtttttacagggagatgatgatgagtaaaaaatcggccaaaaagcgtcagccagtgaagcccgtggtggcgaaagaacctgctcgcaccgccaaaaattttggctatgaagagatgttgagcgagctggaagccatcgtcgcggatgctgaaacgcgtttagccgaggatgaagctaccgcgtaaagacaggtgccggatgcggcgtaaacgccttatccggcctacaaaacccaacaacatcaacaaattgtgcaattcgtaggccagataagacgcgccagcatcgcatccggcacgatacccaaaactggcgtttatctggccttgctcgccataatctcgataatctgccgatccgtttgctgcatcgaatggcttgctaacgcacacaggttggcaatcgactgctcaacatcatgcgccacaatcccttcattgccggtcacggcggtatcatccagcgccattaacaccgctttccacgcagccgaagcactggtcgaaaccttcatcgcgcagctgttcgatgcaccatcgcaaatcatgccactgacatcgccgatcatactgctgatcgccatcgagatggtttcataacgcccatccaccagccatgccatcccggcagcggcccccattgctgcggtcgttgcggcacacagcgcagacaaacgcggtaactggttatggatgtaaatcgcgctcaaatgcgaaagcatcagcgcacgcgccagccgttcatcatccgctccgaagtgttctgctaccaccaccacgggcattgttgcggtgatcccctggttacccgagccggagttactcattgccggaagcgtagcgccgcccatacgcgcatcggatgccgcgctggtacgaatcacaatggatgaagagagatctttcgccagcaaaccgcgcgcgcactgtttttccagcgtcgcaccaatatgcagcccccagttaccgctcaaaccttcctgcgataacgcacaatttaacttcgcagaatcgagaataaagcggatcgccgcaaacgggacttcattgacgaacttcaggatctcagccagcgtcgtcctggaaagcaccgtcagcggcgactcttgctcgccctctgtcacacacgcctgctgggtaaacaccacaccattgtgcgtctcaatatgcacaatgttggtatgcccgccgacgatggtgacacacgcccacttctcaccgttccagactttggcgcgtgagaagaggatttcatcgcaaggttcctggatcttaactgagactttccccgccgccagcagtgctttggcatcggaaattgcctgcgcagttgcgtctttcagcacttccagcccggcgttagcatttccacctaacgctcccagcgccgccgcaattggcagccccaccattcctgtaccaggaacggtgacacccagaccgttcttcatcagatttggcgaaacccaggcttctacacgttcaaccggaccttccagttcagccgcagcaaccgccgccgccagcgccagtgaaatcggttcagtacaccccagcgccggttttacttcctcctgaacggcgaggatgtaacgctgccataacggatttaaagtcgaatcaaacatattaaaaaccttaaaatttcaggtaaatcaagaaaatgccaggaacggagaaacacaaagcaacaaaccagtgacgataatcaggtacagagacatccctttgtatttgtgcaatgccggtactttgtaaaccagccacgccgggatcaggcaccctaccatgccgaaaatcgggctacagatagaggtgaagctcaacaccggggcgttcagtacgatggcgctccaggccagcaaaatggcgaaaatcatgatgccgcgctgaacgagattttcgttaatcttctcggcaggtatcttgcgacgcaggatgttcattacgatcccttgcgttgcttcgcgaaagcctaaatagacgccaaagaatgcagtcattacagcaaagatattgagaatgacgctgaccactttcacccacgctgcgccatcaccgctaataaactgtgcggcaatcgccagcgcggaaatattctgctcgtaggcttttaccgcttcgtcatgtcccatcgccagcgtgaacgacacggcgtagaaaaagacggtgacaaacaaaataccaaacgcgatattcattgcccgcaatgctttatgccgcgccacttcaattgatttttcccgcgaacgataagagatcaccatcgggcttaacgtctggataaacagaatcgacgtcagggtaaacggcagcgtaataatggcgtttttcaccagcagccccagcggcggtagcgaaccgacgttatacagatgccacattcccaccatcgacacgcccagcgccgcgaccaccagcagcttggtcagcaccatgccggtcgaaattttgaataacaatttctcgccgcgtgaggagatcgccaccagaatgcaaatcagtaccagaccataaaagggactgtctgacagcaacccttccgtcacgccgaaggtatgcaggtaggaagcactatcgttggtgatggcggtggaatagacgaacatccaaatcaccagcattacgaaatagagtgcacctaacaggatgccccagtttttacctaaataaccgctgatgacgctcgggtaatctttacactccggtgattctgccagcgtattaataaacaaccgctgaaacagatacattgccgggtaaccaatcaccgatgagagcaaaaatacccataatcccatcaaaccgacctgcaccgggagaaaaacaatccccgcgccaatcgccatcccgatactcataatcacccagccggtgtcagtactgtcgaatttgatcgcttctcgccactcgctctcactcattccagcacgacccgccggggtcgaagcgtctgcaatgacgcctttattcgatgcaatttccataatttctcgctcaatattttgtagggcttattatttttttccgagccgcatcaaggcgatatgcggtctacgtttttgcaggcgagttattagaataaagaaatgatacgcgcgaggtcagagaaaatcttcacaatcaagactttgaaataacggagatggataagaattttctactaaattaatcgcaagagaatattcattctctatttgcggcagatcacaaaaaaaaggtgcacatttgtgcacccaaggatgaaagctgacagcaatgtcagccgcagaccactttaatagccagtcctccgcgtgatgtttcgcggtatttatcgttcatatctttgccggtttcatacatcgtctcgatcactttatcgagtgaaacacgcggtgccgaggtgcggcgcatcgccatccgcgcggcgtttactgctttcacggcattaatggcattacgttcaatgcacgggatttgtacctgtccggcaaccggatcgcaggtcagcccaaggttatgctccatcgcgatttccgccgcattgcatacctgcgccggactgccgcccagtagttcagttaaccctgccgccgccattgaacaggccacgccaatctccccctgacagccgacttccgcgccagagatggaggcgttcattttatacagcgcgccaattgcccccgctgccagaaaatagcgggcaattgaccgctcatttaccggacgacggaacttatcgtaataagccagcactgccggaataatgccgcacgcaccgttagtcggtgccgttaccacgcgcccgccagctgcgttttcttcactaaccgccagcgcgtacatgttgatccagtcgatgacattcatcggatcgttagagatgttatcgctggaaaccagttgacgacgcagcgctacggcacggcgcggcacattgagcggaccaggcagcacgccttcagtattcattccacgttcaataccgtcatgcatcacttgccagatacgggcaaaccctgcgtcaatttccgctttactgcgcagcgccagctcgttgtgcatcatcaggccagatatagacaggccgttgtaatcacacattttcagcagttcacctgctgagtggaaatcgtaaggtacgggtgtttcgacatcgtgcgacaggccgaagtgttcttcttcgacaataaacccgccgccgacagagtaataggttttgcttaatagttcttcctgtcccttccaggcagtgatccgcattccgttctcatggcgaggcaacatttcgggatggaagataatgttctttgctacaggaaaatcaacaatatgcgcgccagaagccaccggcaaccgcccgctgcgcgtcactaactctataaatgcagggatctcatcaatgacaacatcctgcggactgtttcctgccagtcccatgatgatggcgacatccgtggcatggcctttgcccgtcagtgacaacgacccgtacagatcgaccacaatatggctcgtcgcggttaataagccgctactttccagccgatcaataaaactttttccggcattcattggccccacagtatgcgaactggagggaccaatcccaattttgaaaatatcgaatgcactaatcatatccacaccctcggattgccgttcagtaaagtggagcggaacgaccttgcgaccgtcccgctcacgaggccttacgcactacgtactgcgatggcttcaatttccaacttcacatctttcggcaaacgcgcgacctgcacacagctccgggtcgggtaggtcgcctgatgttcatcgaagaactgcttatagacttcattgatggtggcaaaatcattcagatcggtgatgaacacggtcatcttgatgatatcgcccacactcagcccggcagcaaccacgatcgctttgacgttttcgaggcttaaacgcgcctgatcttgcacatcagccgggatctcaccggtctgtgggcaaaccggaatttgcccggaggtgaagaccatgctgcctaaatcaacgccctgaacataagggccgattgcgcctggggcacgttgcgtttcgataatctttttcatacatcctccggcgtcagagcgcctgggtaaaggtacgtgaaataacatcctgttgctgttcacgggtcagtgcgttaaagcgcacggcgtagccagagacacggattgtcaggttaggatatttttccgggtgctcgatggcatccagcagcatttcccgattcattacgttgacgttgaggtgttgaccgccttcgacatccgcttcgtggtggaaatacccatccagcaggccgacaaggttcgttttacgtatcggatcttctttgcccagcgccgcagggacgatggagaaggtgtacgagatcccatctttggcgtaggtgaatggcagtttcgccaccgacgtcaatgaggctacggcgcctttgcgatcacgaccgtgcatcgggttagcgcccggcgcgaacggtgttccggcgcggcgaccgtccggcgtgttcccggttttctgaccgtacaccacgttagaggtgatagtcagaatcgattgggtcggcacagcattgcgataggttggcaaagctttaattttcttcataaagcgttcaaccagatcgcaggcaatgctgtctacgcgctcgtcgttgttgccatactgcggatattcgccgtcaatctcgaaatccaccgccaggccgttttcatcacggattggtttcacacgagcatatttgatggcagacagggagtccgttgccaccgacaggcccgcgatgccgcacgccatggtgcgatagacatcacgatcatgtagcgccatcagcgaagcttcgtagctgtacttgtcgtgcatgtagtgaatgatattcagcgcgctgatgtactgtaccgccagccagtccatgaagtggtcgaggctatccatcactttgtcgtagtccagcacgtcatccatcaacggagccgttttcgggccaacctgaatcttcagcttctcgtccattccgccgttgattgcgtacagtagcgttttcgccaggttagcgcgtgctccaaagaactgcatttgcttaccaatcaccattgggctgacgcaacaggcaatcgcgtaatcgtcgctattgaagtcagtacgcatcagatcgtcgttttcatactgcaaagaggatgtgacgatagacacctgcgcggcatattttttgaaggcaatcggcaaggcttccgaccacagaatagtcaggttaggttccggtgcaggccccatagtgtgcagggtgtgcaaatagcggaaggagtttttggtcaccagggttcgaccgtccagccccatcccgccgatcacttccgtcgcccagatcgggtcgccggagaacagcgaatcaaattccggcgtacgcaagaagcgcaccatacggatcttcatgatgaagtggtcgatcagttcctgtgcctgctgctcattgagtacgcctgctttaaagtcgcgctcaatgtagatatcgaggaacgatgccgtgcgccccagcgacatcgcgccgccgttttgcgatttcactgccgccaggtaagcgaagtagagccactgcacggcttcttgtgcattctgcgccggacgggagatatcaaagccatatttcgccgccatttcctgaatctgtaacagcgcacggcgatgttctgccagttcctcacgcagacgaatggtggcttcaagatcttcgcctttttccagacgggactggagatcggcaaactgcagttcgcgttcacgtaccagataactgatgccgtacagtgccacacggcgatagtcaccgatgatacgcccacgaccataaccatctggtaaaccggtcagtacaccagatttacggcagcgcagcatatccggtgagtaaacatcaaatacgccctggttatgggttttacgcagatcggtaaagatgtattcaaattcgctatccatttcacgaccatacgcgtggaatgaacttctaatcatattaatgccgccgaacggatgcagcgcacgctttaatggcgcatccgtttgcagacccactattttttccagcggctggtcaatatatcctgcatcatgagcggtaattgtggtggcaatattggtatcgaaatccaatggcgcgtgagtcgcattttcgatacggatgccttccatgactttttcccacaattccgtggtggcaggcgtcgcttcggcgagaaaagattcatcgccttcataaggtgtatagttatgttgaataaaatcgcggacattaatttcgtttttccagtccgtacctttaaagccaagccatgcgtcggcgtacagcttatcgctggtatcaatatctaccttcatgaaaaataatctctctacaatacttcaactaaattatgcaaattctgcgggcgcgttcactttgcctaaatgaatggcatccaaagcaatcattttttcttcattagtcggaattacggcgcaaatgacacgcgcattttcactggaaacaattcgctctccaaaagagttagagcgattattcatttctgtatcaatctctacgcctaatacagctaaatgttccatgaccagacgacgaattaaacttgaattctctcctattccgccggtgaatataattccatccaggcgatgtaatgaagcagcgtgtccggcaatatgacgggcaattcggtgaacaaaggttttaattgccagttgcgcgcgttcgtgaccttcatgccaggctttttccagaacacgtaaatccgaagaaaggccggaaatacctaataatcccgactctttattcactacgcgttccaggtcccccaggctctggttggtttggctggcgacccaggacatcgccccgaagtcgacatcaccactgcgggtacccatcatcaagccttccagcggcgtcattcccatggaagtgtcaacactctgaccgttgcgaaccgcgcagattgacgcgccattgccaagatgcgccacaaccaggccggagtcatcttccgccagattcagcagagaatgcgcgcgctgggaaacatagcggtgcgacgtgccgtggaaaccataacggcgtacacctaactcttcataatatttccacggcaggccgtataaataagcttccggagccatcgtctggtggaaactggtatcaaataccgccacctgagttacgcccgggaataattgctgcgccgattcaataccacttaaattggcgtaattatgcaggggtgccagtggagaaacgcgacggatattatcaatgacttcatcggtaataatggcggactcggtaaaaatactgccgccgtgagcgatgcggtggccaattaaggccacattgtcatttaaattccgtttttccagttcaaatgcaattgccttcaatgcaccttcgtagctgtggtgagccagcggtgctggctctcccccatttacggataagaatgcattttccgagttaataccgtcggcaatacctgacattaatacttcacagtcgctggcattgagtacggaaaacttaatcgaagacgaaccacagttaataaccaaaacaaccggaaattcattcatctcttttctcatcctgagttacggattaaaacagtttgtatacgatgttcaggatggtcagcagaccaatcacggtaacaaacacgttatccagacgaccacggtatttcgccagagacggcgctttacggatggcatacatcggcaacaggcacagcagtgatgcgataatcggtgcgcccatggcttcaatcaggtcgaggatgttcgggttggcgtaggcaacaacccaggtggagcccataatgaaaatcatgctgatagtattcagtttacccagcgacactttggttttgtcacctttataaccgaacttcagaatcaaaccattcagcccttccagcgtccccagatagtgaccgaagaaagatttgaaaatagccacgagtgcgatgatggaagcggcatattccagtgtaatcgcaaacgttgttttggtaccggtcatggacgcaaagtggttagccagataagaaagcactggaatattctgcgctttcgcttcagccatattcgccggagacagcgtaaacaggcagctaaaggcaaagaacatcaccactgcaaccatcagcatactggcgcgagagatgatttgtgaacatttacgctcggtgaagtcgcgaccaaaatctttctcgtactcttcacgtttagaaacaacgaaggaagagacgattggcgagaagttaaaggagaaaaccatgatggaaatccccagccagacggtgatcaggataccgtcatgaccagttaacgacagcgaaccgaggtcaacctggtcgataactgcagagttccagtaagggatcagcgaaagagaaatcagcaccaggctggcgataaacggccataccagatagctcatcactttaaccatcagatccttaccaaaccagatgacgaaagccatcagcagcaacaggaacagcgccacaaagccgcgattcagcggtgcaaagccgagctggttttcccagaacgtcataaaggtattggtaatggtaacgccataaatccacaacagtgggcaaatcgcgaagaagtacaggaacgtgataaccacgccgccagttttaccaaaatgctcttccaccgtttccgtaatgttgccggaagggttagagccagaaagacacagacgcgccagtgcccggtggcaataaaacgcgatggggtatgctaataccaacatcagaagaatcgggatcagtccgccaaaacctgcgcggatagggaagaacagcaccccggcgccgattgccgtaccaaacaagcctaacgtccatgtggtatctgatttacgccaggacgattgttttgtctggctggatacaatgctatctgaagtactcatatcctatcctcaacgaattaattaagcgtcaacgaaaccggtgatttgagagacgcgagaaagatcgatattgccgccggaaataatactgacggtttttctgttttgaatatattggtctaatttaccgcttaataatgcagcacatgccagagcgcctgcgccttcggtgacgactttattgcgctgaattaaggcaatcatactgtttctgatttcgtcttcgctgaccagcacgatgtcatcgactaattcacgaacgatttcgtaagttaaattacccgggcgggagacatcacaaccatccgccagggtgccggtagttcggtgcgtagttatttctccggagtggaaagaagccgccatgccgtgaacgttttcagactgtacgccaataacacggatggtcgggttgatagatttaattgccaccgcaataccagcaattaaaccgccgccgccaattggcacaatcacgttatcgacatcatagagatcttccataatttccagaccaatcgttccctggccagcaatcactttcggatcatcgtaaggtgggataaaaatacggccttccatttcgacaatttcgctcactttagcaatagtgtcgttgaagttatcaccatgcaaaacgacttctgcggagtagtcgcacgttgccgcgactttggatttcggcgcaccttttggcatcaccactttaccgtcaatacccagcatcgcgcaggagagcgaaaccccttgcgcatggttgcccgcagagcaggccactacacctttacgtttttccgcatcagtcagtgaacttaatttattaaatgcgccacgaattttaaatgaaccggtacgctgcatgttttcgaatttgaggaatatttcacctttgcaacgttcactaaaatagttggagcgaggcatacctgttttataaattcgcccagccagtcgttgttttgcttcaatgatgtcatcaatagcaaccgggagatcgtatgtaatatgcattataaaacctcttagcctgaattaaatatgtaggtaaccgtaaccgacacctgcaaaacagacaggtggattatttatgtttaaattaaaacaaataactaatcaacttcaattaattgccttcgtctacacccattataagatgaatactctttggctaattccaccaaaaccgatgctgcttttttaatacgataatttttcgaccataccgcggcatattgtgccacaggtaatgtttcttcaaccggaatagtaataaattgattagaaccaaaaggtgatgtcatatcacaaggaattacagttaagaaatcagcattgagaacaagattataaattgtcacgactgagtcggttttaacgatgttttcaatactgatgccatttctttgtaacgtagtaagtagttcgctgtagtaccccatattggtttgtggcaacacccactgttcgttcttcaacgactccagcgtggtggtgccggtgcatgttcgggacttactggctaccagcacaaactcggactcgaacagcggctcaacatgtaaatcctgaagcttcatttctgcgcttaacgtaccaatcgcaaaatccagtcggccgtcgcggattgccggtaagaacgaagacagttgcgcttcatacatagaaacctgcgctttcgggaacacctctttgaacttgttgatcatccctgacataaaagtaaaaccaatcaatgaaggaaaaccaaatgagacttccaccaccgcctcagaagacataccgcttatctcattaaccatatttttcatttcacgggtaatggattcggaacgggagagtaacaattgaccggcaggtgttaatgttacaccggtatttttccgcaccactaactccacaccaaaataatcttcaatatcgttaatgattttactgacggccggttgagttaaccctaactcttttgcagccgagccgatagaaccacttctaataacttcctgaaagactaccaggtgctgcgttttcggaagaagaatagtgctcataacgacctacgttaattacctcattgacggcatgaagtgtatcaaaatgaaatgaacaggatatgtgcgaccactcacaaattaactttcaatactttccatggcatcgttaccaaaattaaatacccttaagtatcaacaagttaaagtatgaaaaatcagcataaaccctgatttttgtcaaaaaaaatgacggggataaccatattttatggcgataacatcattctttatgtggttaatacaaaaaaggggctgagactatatttcaagcaattaccggataattaccaggcaaaatttgagttaaatttaatgagtaagttctcaaattttattataaacaaaccattttcagcgataaataatgcggcacgtcacattttttcacgctatttgttggagaacaaacatttattttatcaatattttaaaatttcgaatacaggtattgatcatctcgaacaattgattaacgtcaaccttttctcttctggcaggacgtcattttgtgaatgcaatcgttttccataaattcttctcccctcataggcaacgaatagcattttgtgttgaggatcacaaaacgaataattgctggtcgccgcgataaggtcagacgaagacaacaagggggattctcactgtgctttacatcagcgtaggccatagaatgttgcttcgttgactgtaatgccgggtaaatgagcattttttgatagtgcgaaagaaccctgcgaggaaaataagcatctattattgtttgtcatgatgacaggcaggcatcaatgaaaggcttctcaattgcacatatttttcacccttcaatcccgtcaatgcacgcagtggttaacaatcacaatagaaatattgattattggacggtaaaaatttaggttataacgcccaaatgattcaacgatcggacaatacctgcgaacttacaattaatgagagaaatatacgtataattacgaccttttaaatgcaatatagacttaataacttcttacaaagtctgttattaataccgtagatattcatcttaccctgtgcaccaaaagcaaaaacccgccgaagcgggtttttacgtaaatcaggtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccgcttacgcgggccatcggcggtttgctctctgttgcactggtcgtgggtttcccccccaggcgttacctggcaccctgccctatggagcccggactttcctcccctccgcccgtctcccccgaagaggacgacgacgaagcggcgactgtctggtcagcttcggcgcgcagtatagagggtttgcgcgcccttgtcaccccgcgttgcgcattccaatcgccagtgtcgcggcgatattacgtgaagcacggcagatattgtcataagctccgcggaatgcttcgtctaacgtaccaatgctggtcagtacgctgaagaccgcatcaatgccatgctgatgtacaacgccaacatcattggtcaggctacccgcaatgccaatcaccggtttatggtacttcttcgccacgtttgcgacaccaatcggtaccttgccgtgaatactctggctatcaatacgcccttcaccagtgatcaccagcgtacaatcgtgaatatgttcctccagattcagcgccgtagtgacgatttcaataccacttttcagttctgcaccaagaaacgccatcagcgccgcgcccataccgcccgcagctcctgcgccggggacatctttcacatcaacatgcagcgcttttttaatgacatcggcatagtgagagaggttattatccagctcgacaatcatcgcctcactggctcccttttgtgggccaaagatgcgcgaagcaccactgtcgccgactaacgggttggtgacatcacaagcgacgcggatgacacaatcttttaagcgcggatcgagaccggaaatatcaatatcattcagagtattaagactaccgccgccaaaaccaatttcattgccgttggcatcgcataatttcgcccccagcgcctgtaccatgcctgcgccgccgtcgttggtggcgctgccgccaatgccgataataatgtttgtcgcaccgctctccagcgcctgcaggattaactcaccagtaccgcgtgaagtggtcacgagtggatcgcgtttttccgcaggtaccagttccagcccactggccgccgccatttcgataaacgcggttttgccatcgccggagatcccccaactggcattcactttctcgcccagcggccctgtaacccaggcgtgacgttcagccccctgggtggctgcaatcatcgcttccaccgttccttcaccaccgtcggcaaccggaacagaaacatactgtgcatcaggaaaaatttcccgaaatcctttttctatcgcctgcgcaacctcgctggcagataaactttctttataagagtctggggcgattacgattttcatacctatgcctgttaccacatgacgccggagggcgtttctcttattcggcctggattccaggcccggattgcaatacgccatccgggcacgacgtcattagcgagtaacttcgactttcgccagtttttcgtagtagcacgccagggcgctatgatccgccattcctaaaccatctgcacgcagtgcctgcatcatctccataaccgcagctgtgagcggcagttgcgcgccgacgccgtgagaagtatccagcgcattcgccagatccttaatatgcagatcaatacggaagcccggtttgaagttgcggtccatcaccatcggcgctttggcatccagcacggtactgcccgccagcccaccgcgaattgcctgatacaccagatccgggttaacgcccgctttggttgccagcgttaacgcttctgacatcgcagcaatattcagcgccacaatgacctgatttgccagtttggtgacgttacctgcaccgatttccccggtatgcaccacggaacccgccatcgctttcatcaaatcatagtatttgtcgaaaatagccttgtcgccgcccaccatcactgacagcgtaccgtcgatggctttcggttcaccgccgctcaccggggcgtccagcatatcaatgcctttcgctttcagcgcttcgctgatttcacggcttgccagcggtgcgatcgaactcatatcgatcaataccgtacctggcttcgcgccttcaataatgccattctcacccagcgccacctctttcacatgaggggagtttggcagcatggtgatgatgacgtcgcactgttcagcgatcgctttagccgtagaggctgtttctgcaccggcagcaatcacgtcagcgatagcttctgggttacggtcagcaaccaccagcgagtaacctgctttcaaaaggtttttactcattggtttacccataatcccaaggccaataaaaccaactttcatagtcatatcaatcatctctcttattgcggtggtggttattttttaaaggtatcagccagtttctgagtggcagagcggaagacgccgagatcgctgccgacggccacaaacgtcgcgccccattccagataacgacgcgcatcagcctcgactggtgcgaggatgccgctgggtttgccgtgcgcgctggcacggttaaaaatgtgctgaattgctttttgtacatccggatgcgaggcattgccgagatggcctaatgccgcagccagatcgctggggccgacgaagatgccgtctacaccttcggtagcggcaatagcatcgacgttatctacgccctgctgactttctatctggaccagaatagtgatgttcttgttcgactgagcgaaataatccgccacggtgccaaacatattggcgcggtgagaaacggagacgccgcgaatgccttccggtgggtaacgagttgatgccaccgcctgctctgcttcctcttttgtttctacaaaaggaatcaggaagttatagaaaccgatatccagaagacgcttaataattaccggctcgttggtcggcactcgcactactggcgcgctggcgctgcctttcagggccattaactgcggaataaacgtggagatatcgtttggcgcatgttcaccatccagcaccagccagtcaaacccagccaaaccaagaacttcagtgctaatcgggttagagagagctgaccagcaaccaatttgtacctgtttcgcagccagtgcggctttgaatttattcgggaaaacatcgttattcatcgcttatacctttgcttatttctgcaattccatacgtttaatgtcgccgactacgaagaggtagcagaccatcgccatcagcgctgaacatcccacaaaaaccagtgctgcattgaaggagtgcagttcacttaccaggtagccaatcaccagtggagtgacaatggaggcaacattgccaaagacgttaaagacgccgccgcagaggccaacaatctctttcggcgcggtgtcagaaatcactggccagcccagcgcaccaaatcctttaccaaagaaagccagcgccatcagcatgaccaccagcgtggtgttgttggtgtagttacataagatgatggtggaagccagcaacattcccagcacaattggtagcttacgagccagggtcagggacaaaccgcgtttgatcagataatccgagaagacacctcccagcacgccgcccgcaaagccacacagtgccggaatcgaggcgaccagacccactttcagaatcgacatgcctttttcctgcaccagataaattgggaaccaggtgaggaagaaccaggtgatggtgttgataaaatattgtccgaaaaatacgcccagcatcatgcggttagagagcaattgcttgatgtaatgcagtttgggtccgcttgctgccgcactgcccggctttttgtggtccatatcgaccaccgcgccattttccgagataaacttcagctcttccgcagacatacgtgggtgatctgtcggattatgaatcaacttgatccacagcgccgtcagcacaaaaccaatcacccccataacggtaaagacgtgctcccagccccaggcgaaagtcagccagccaagcagcggcgaaaagagcgccaacgagaaatattgcgccgagttaaagatggcggaggcagtaccacgttctttcgtcgggaaccaggcggcgacaatacgggcgttcgccgggaatgatggcgcttccgagaaccccagcataaatcgcataaagaacatggagatcccagcccaggccagcggaaacatatcgacaaagccttgcaggaaggtgaacagcgaccagaaaaagaggctgtaagtgtaaactttcttcgagccaaacttatcaagcagccagccgccgggaatttgcatcagcaagtaggcccagccaaaagcagagaagatgtaacccatcgaaaccgcacttaactgcaactcttttgccacttcggtaccagcaatagacagtgttgcacgatcggcgtagttaacggcggtaacaataaaaataatcagtaatattaaatagcgggtatgcacgcctttctttttttcgtcaacggtgtccagcatcattttatttacctcgggtacttatgctgatttttattattatggggaaggtgttatttatgagtttcatttatgccgttacgacaatgaactcgggaattagtataagcagcgcgagaataataatcattgtgcaaatgctaatttaattaatactatttaaatattattttgagcatatgcacataaggttgcgcgctaaagcacagatttgcgctttaccttgccgggaggtactgcaatccctgaaatgattgacattgatcacatttctgcatttaaactcctgacattcttatttcacccaatgaagttatttatttttaaatgagaccaggtcctcattttaatagtccctggctggagaatattgcacaatggccaacatcgaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaggtgattggttacgccgtgcgcgcaatcccacgcggaagctggatcgacgaatcaatggttgtactaccggaagcgccgccgttacatacgctgccactggcaaccaaagtcccggaacccttaccgccgctggaaggatacacctttgagggctatcgcaatgccgatggcagcgtgggcaccaaaaacctgctcggcatcaccaccagcgtccactgtgtggcaggcgtggtggactacgtagtaaaaatcattgaacgcgatctgctaccgaaatacccgaacgtcgatggcgtggtggggctgaatcatttgtacggttgtggcgtggcgattaacgcacccgcggcagttgtacctattcgtaccattcacaatatttcgctgaaccctaactttggcggcgaagtaatggtgattggtctgggttgtgaaaagttgcagcctgaacgcctactgactggaacggatgatgtgcaagctattccagtagaaagcgccagcattgtcagtttgcaggatgaaaagcatgtcggttttcagtccatggtcgaggatattttgcaggtcgccgaatgccatctacaaaaactgaatcaacgtcagcgagaaacctgtccggcttcagaactggttgtcggcatgcagtgcggtggcagcgatgcgttttctggcgtaacggcaaacccggcggttgggtatgcgtctgatctattggtgcgctgcggcgcaacggtgatgttttcagaagtcacagaagtgcgtgacgcgatacatctgctgacaccacgcgcagtgaacgaagaggtcggcaaacggctgctggaggagatggagtggtacgataactatctcaatatgggaaaaaccgatcgcagcgccaacccttcgccggggaacaagaaaggcggtctggcaaatgtggtggagaaggcactcggctccattgctaaatcgggtaaaagtgcaattgttgaagtgctgtcgcccggccaacgcccgactaaacgcggattaatttacgccgcgacgccagccagcgattttgtctgtggcacgcaacaggtggcttcgggtatcaccgtgcaagtgtttacgaccggtcgtggtacgccgtacggcctgatggcggtacccgtcattaaaatggcgacccgcaccgagctggcgaaccgctggtttgatttaatggatattaacgcgggcactatcgctaccggcgaagaaaccattgaagaagtgggctggaagttgttccactttattctcgacgtcgccagcgggaagaagaaaactttctcggatcaatggggactgcataaccagctggcggtgtttaacccggcaccggtgacctgataattcaattcgtattatgcccgatagcacacgtttatcgggcatattgagtcacagcgaagacgcgtgatccccgaccagaatcacttcaaccccagcctttctcagtccttccagactatccgaaggaatgccttcatcaacaatgatcatgtcgatacgttgagtatcaatgatcttatgtaaactagaacgattgaacttactggaatcggtgaccacgatgatccgttccgcaacttcgcacatccgacggtttaaacgggcttcatcttcattatgcgtgctgacgccgcgctccagatcgatcgcatctacaccaagaaacagcatatcgaagtggtaattttgcagcgattgctcagcctgatcaccgtaaaaagattgcgactgacggcgcaaatgccccccggtcatcagcagctcaacgccttccgcttccagcaacgcattagccacgttcataccgttggtcatcgcaattacgtcggtgtgcttgcgcatcagacgagcaatctcaaaagtggtggtcccggagtcgaggatcacccgatgaccaggctgaatcaactcaacggcagctttcgcaacgctgcgtttcatcgcggtgttcagcgcgcttttatcttccactgatggctcgactgacggcgttgtgctatcgcagatcaacgcgccaccataggcacgcacagcgatcccctgcttttccagaaacgccagatcgttgcggatcgtcacagtagatacaccatacaacgccgatagatcattaacttgcacacttccttgctggcgcaggcgttgaatgatctgctctcgtcgctcactggtgcctgtcactcgcttctcacctgaagcgtcggtattactcatagtaagtcctttcgtaaaactttcgtttcatttcgttttgcctattaacgcctttctattaagcaaatgcaagcccaccttacccattggcgcaagctactctcgtttcagtggctttcattatgtttcttttgtgaatcagatcagaaaactattatctttcgttttatttttatctcaccatgacgcagtatcaactgaaacaaaacgaaagattaatgtcgcagtaatctgaactggagaggaaagtgaaacatctgacagaaatggtgagacagcacaaagcgggcaaaacaaatgggatttatgccgtttgttccgcacatccgctggtgctggaagctgcaatccgctacgccagtgcaaaccaaacgccgttactgattgaagcaacctccaatcaggtggaccagttcggcggttataccggaatgacgcccgccgattttcgcggctttgtttgtcagctcgccgactcgttgaatttcccgcaggatgcgctgattctgggtggtgaccatctggggccaaaccgctggcaaaacctgcctgccgctcaggcaatggccaatgccgatgatttgattaaaagctacgtggcggcaggattcaaaaaaattcaccttgattgcagcatgtcctgtcaggacgatccgattcccttaactgatgacatcgtggctgaacgcgccgcccgtctggcgaaagtggcggaagaaacctgtcgtgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcagggtctgaatgccatctggccacgcatcattgccctggtggttcaacccggcgtcgaattcgatcacaccaacgttattgattatcagccagccaaagccgctgccttaagccagatggtcgaaaactacgaaacgctgattttcgaagcgcactctaccgattatcaaacgccgcaatcgctgcgccagctggtgattgaccactttgccattctgaaagttggcccggcgctgaccttcgccctgcgtgaagctctgttctctctggcggcgattgaagaagaactggtgccagcaaaagcctgttctggtctgcgtcaggtgctggaaaacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggttcgtaatctggcggattcaccaattccgctgccgctgatcagtcagtatctgccgctgcagtacgtgaaagttcgctccggcgagctgcagccaacgccacgggaactcattatcaaccatattcaggacatcctggcgcagtaccacacagcctgtgaaggccaataagcaaaacaaagaggaacacgctatgccaaatattgttttaagtcggattgatgaacgcttgattcacggtcaggtcggcgttcagtgggtcggatttgcgggggcaaatctggtgctggtagccaacgacgaggttgccgaagatctggtacaacaaaacctgatggaaatggtactggcagaagggatcgccgtacgtttctggacgttgcaaaaagtcatcgataacattcatcgcgccgccgatcgacagaaaatcctgctggtttgtaaaacaccggccgatttcctgacgctggtgaaaggtggcgttccggtgaatcgcattaacgttggcaatatgcactacgccaatggcaagcaacaaatcgccaaaacggtttctgtggatgcgggtgatatcgcagcatttaacgacctgaaagccgctggggtggaatgcttcgttcagggcgtcccgacagagcctgcagtggacctctttaaattactttgagggattcatcatggaaatcagtctgttgcaggcattcgcgttgggcattatcgcctttatcgctggcctggatatgtttaacggcttaacccatatgcaccgcccggtggttctcggcccgttggtcgggctggtacttggcgatctgcataccggtattttaaccggcggtacgctggaactggtgtggatggggctggcccctctggcgggcgcacagccgcctaacgtgattatcggtactatcgtcggcacggcgtttgccattactactggcgtgaaacccgatgtcgcggtcggtgtcgccgtacctttcgctgtcgcagtacagatggggattaccttcctgttctcggtgatgtccggcgtgatgtcccgatgcgaccggatggcggagaacgccgatactcgcggcattgaacgcgtgaactatctggcactgctggcactcggcacgttctattttctctgcgctttcctgcctatctacttcggcgcggaacatgcaaaaaccatcattgatgtcctgccgcaacgattaatcgacggcctcggcgtcgcgggcggcatcatgccagcaatcggttttgccgtgctgctgaaaatcatgatgaaaaacgtctacatcccctacttcatcctgggctttgttgccgcagcctggctcaagttaccggtgctggctattgctgccgccgcgctggcgatggcgctgatcgacctgctgcgtaaatctcctgaaccgactcaacctgcggcacagaaagaggaatttgaagatggcatctaatcaaaccaccctgccgaacgtcagtgaaaacgaagaaacactgctgactggcgtcaatgaaaacgtgtatgaagatcagagcattggcgcagagctgacgaaaaaagatatcaaccgcgtcgcctggcgttccatgctgttacaggcttctttcaactacgaacgtatgcaggcttccggctggctgtacggcctgctgccagcactgaaaaagatccacactaataaacgcgacctggcgcgcgccatgaaggggcatatgggtttcttcaatacccatccgtttctggtgacgtttgttatcggcattatccttgcgatggagcgttctaagcaggacgttaacagtattcagagcaccaaaattgccgtcggtgcgccgctcggcgggattggcgatgcgatgttctggctaacgctactgccgatttgtggcgggataggtgcaagcctcgcgctacaaggctctattcttggcgctgtcgtctttattgtgctgttcaacgtggtgcacctggggctgcgttttggtctggcgcattatgcttaccgcatgggcgtggcggcgattccactcattaaagcaaataccaaaaaagtcggccatgcggcatctatcgttgggatgacggtaatcggcgcgctggtggcaacctatgttcgtttaagcaccacgctggaaatcaccgcgggcgacgcagtggttaagttacaggctgatgttatcgacaaactgatgccagccttcttaccgctggtctacaccctgaccatgttctggctggtacgccgcggctggagtccgctgcgcctgattgcgattaccgtggttctcggcatcgtcggtaaattctgccatttcctttaaatacaatgaggtattagatgttaagtattattttgacagggcatggcggatttgccagcggcatggaaaaagcaatgaagcaaattctcggtgagcaatcgcagtttatcgccatcgattttccggaaacctcaagcaccgcgctgcttacatcgcagcttgaagaggccatcgcccaactggattgtgaagacggcattgtttttctgacggatttgctgggcggcacgccgtttcgcgtagcttcaacgctggcgatgcaaaaaccgggctgtgaagtgatcaccggcaccaatttgcaactgctactggaaatggtgctggagcgcgaagggttaagcggtgaagagttccgtgtgcaggcgctggagtgtggacaccgtgggctgaccagtctggtggacgagttaggccgctgccatgaagaatgtccggtcgaggaaggaatatgacacacgttctgcgcgccagaaggctgctgactgaagagggatggctcgatgaccatcagttgcgtattgctgacggtgtaatcgcagcaatcgaaccgattccagtgggcgtgactgaacgcgatgcggaactgctctgtcccgcttacatcgacacccatgtacacggtggtgcgggcgttgatgtaatggatgacgcgccggatgtgctcgacaagctggcaatgcacaaagcacgcgaaggtgtcggcagttggttaccgaccaccgtaaccgcgccgcttaataccattcatgcggcgctggaacgtattgctcaacgttgccaacgcggcggacctggtgcgcaagtgctggggagttatctcgaaggaccgtacttcacgccgcagaataaaggcgcgcatccaccggagctgttccgcgagctggaaattgccgagctggatcaattgattgccgtttctcagcataccttgcgcgtggtggcgctggcaccggaaaaagaaggggcattgcaggccatccgccatcttaaacagcaaaacgtacgggtgatgctggggcatagcgcggcgacctggcaacaaacccgtgccgcgtttgatgctggtgccgacggcctggtgcattgctataacgggatgacaggtttacatcaccgcgaaccgggaatggttggcgcgggattaacagacaagcgcgcctggctggaactgatagccgatggtcatcatgtacatccggcggcaatgtcgctctgttgttgctgtgcgaaagagaggatcgtactgatcaccgacgcgatgcaggcagccgggatgccggatggtcactatacgttatgtggtgaagaagtgcagatgcgcggtggcgttgtccgtaccgcgtccggtgggctggcgggcagtacgctgtctgtcgatgcggcagtgcgcaacatggtcgagttgacgggcgtaacgcctgcggaagccatccatatggcgtcgctgcatccggcgcgaatgctgggtgttgatggtgttctgggatcgcttaaaccgggcaaacgcgccagcgtcgttgcgctggatagcgggctgcatgtgcaacaaatctggattcagggtcaattagcttcgttttgatggtttgctcctttattaggccttcacttcccccgtaaggccttctttttctttcgttttgatctgtgcagcggtgtcggatgcgacgctaatgcgtcttatccgacctacggttggtgaccgtaaggccggataaagtatttacgccgcatccagcaatcccttttacttcccttgccttttctttcaacgatcacagatttcgttttatttcctttttcttcattgaactttcagtttcttttctataaattttaaccaacgaaagaaatcaccaagtgaaatgaaacgaaaggcaagcgaaagcgacaacgccgacgtcaagttcatcagactaaggattgagttatgccagaaaattacacccctgctgctgccgcaaccggtacatggactgaagaagagatccgccatcagcctcgcgcatggatccgttcactcaccaacatcgacgcgctacgttccgcgctcaataacttccttgaaccgttactgcgcaaagagaatctgcggatcatcctgaccggagccggaacctcggcatttatcggtgacatcatcgcgccgtggctcgccagccataccggtaaaaacttcagcgccgtaccgaccaccgatctggtcactaatccgatggactacctgaatccagctcatccgctgctgttgatctccttcggtcgatccggcaacagcccggaaagcgtcgccgccgtggaactggcaaatcaatttgtaccagaatgctatcacctgccgatcacctgcaacgaagcgggcgctctttaccaaaacgcgatcaacagcgacaacgcgtttgccctgctgatgcccgcagaaacgcacgatcgcggcttcgcgatgaccagcagcattaccaccatgatggccagctgcctcgcggttttcgcacctgagacgatcaacagccaaaccttccgcgatgtggcggatcgttgccaggcgatcctgacctcactgggcgatttcagcgaaggtgtgtttggttacgcaccgtggaaacggatcgtttatctcggcagcggtggcttacagggcgcagcacgcgagtcggcgctgaaagtgctggaactgacagcgggtaaactggcggccttctatgattccccgaccggattccgtcatggcccgaaatcgctggtcgataacgaaacgctggtggtggtgtttgtctccagccacccttacacccgtcagtatgatcttgatctgctggcagaactccgccgcgataaccaggcaatgcgcgtaatcgccatcgccgcggaaagcaacgacgttattgccgccggtccacatatcatcctgccgccgtcccgtcactttatcgacgttgagcaggcattttgcttcctgatgtacgcccagacatttgcactgatgcagtcgctgcacatgggtaatacgccggataccccatcagccagtggcaccgttaaccgcgtggtgcaaggcgtaatcattcatccgtggcaggcataagaggatcgcattatgagcattatctccaccaaatatctgttacaggacgcccaggccaatggctacgcggtgcctgcctttaacattcataacgccgagacgatccaggcgatcctcgaagtgtgcagtgaaatgcgatcgccggtgatcctcgccgggacgccggggacctttaagcatatcgcgctggaagagatctacgccctgtgtagcgcctattccacgacctataacatgccgctggcactgcatctcgatcaccacgaatcgctggatgatattcgccgtaaagtccacgcaggcgtgcgcagcgcgatgatcgacggcagtcatttcccgtttgccgagaacgtgaagctggtgaaatcggttgtcgacttctgccactcccaggattgcagcgtggaagcagaactgggccgcctcggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgtcccggatgaatttgtccgtcgcactattgaacttggcgtaacaaaagtgaacgttgccacagaattaaaaatagccttcgctggcgcggttaaagcctggtttgcggaaaatcctcagggtaatgatcctcgttattatatgcgcgtcggaatggatgcgatgaaagaagttgtcagaaataaaattaatgtctgtggttcagcgaatcgaatttcagcataatcattagttttttatgatttatcccaatgtacttcccgattaatatcggggagtgccttaatggtaaaggagataactaaaccttaataaatacatcagtacaatatcgcaacaataatatatttaaaaagattatattattcaactttatggtgaggattacacaatgagcagtccaaatattctcttaacccgtattgataaccgtctggttcacggtcaggttggcgtgacctggacatccaccatcggtgcgaatctgttagtagtcgtggatgatgttgtcgctaacgatgatattcaacagaaattaatgggtattaccgcagaaacctacggctttggcattcgtttctttactatcgaaaaaaccattaacgtcatcggcaaagctgcaccacatcagaagatcttcctgatttgccgtacgccacaaacggtacgtaaattggtagaaggtggtattgacctgaaagatgtcaacgtcggcaatatgcatttctcggaagggaaaaagcaaatcagcagtaaagtttatgtcgatgaccaggatctcacggatttacgttttattaaacaacgtggcgtaaatgttttcattcaggacgtccctggcgatcaaaaagaacaaatccctgactaaatctaaaatagccttaatattggtttgaggtaataaaaatgcatgaaataaccctactccagggattatccctggcggcgttagttttctttctggggattgatttttagctggaagccttatttttattccgcccgataatcgtttgtacccttacaggtgctattctcggtgatattcagactggcttaattaccggtggcctgacagagttggctttcgccggattaacccctgcaggtggtgttcagccgcccaaccctattatggcgggtctgatgaccactgtcattgcatggtctacgggcgttgatgccaaaacggcaattggtcttggcctgccgtttagtttgttaatgcagtacgtcattctgttcttctattccgctttctcattatttatgaccaaagccgataaatgcgcaaaagaggcggatacggcagcattttcccgacttaactgggcaacgatgctcatcgtcgcttcagcgtatgcggtgattgctttcctctgtacttacctggcacaaggggcgatgcaggcgctggtgaaagcgatgcccgcctggctgacccacggctttgaagtggctggcggtattctgcctgccgttggttttggcttgctgctgcgcgtgatgttcaaagcacaatatatcccttacctgatcgccggtttcctgtttgtttgctacatccaggtcagcaacctgttgccggttgccgtactgggcgcaggctttgcggtgtatgagtttttcaatgcgaaatcccggcagcaagcgcaaccgcagcccgttgccagtaaaaatgaagaagaggactacagcaatgggatctgaaatcagtaaaaaagatatcacccgtctgggctttcgttcgtcactgctacaagcaagctttaactacgaaaggatgcaggcgggcggttttacctgggcgatgttgccgatcctgaaaaagatttataaggacgacaaaccgggcctaagcgcggcgatgaaagataacctcgaatttattaatacccaccctaatctggtcggattcctgatggggttattaatttcgatggaagaaaaaggagaaaaccgcgacaccattaaaggcctcaaagtggcgctgtttggcccaatcgccgggattggcgatgcgattttctggtttaccttgttgccaattatggcggggatttgctcatcgtttgccagtcaggggaacctgttgggaccgattttgtttttcgccgtttacctgcttatctttttcctgcgcgtcggctggacccacgtcggttattcagtcggcgtgaaggctatcgataaagtgcgagagaactcgcagatgattgctcgttcggcaactatcctcgggatcacagtaatcggcgggctgatcgcttcgtatgtgcatattaacgtggtgacgtcgtttgccatcgacagtacccacagcgtcgcactgcaacaggatttcttcgataaagtcttcccgaatattttaccgatggcctacaccctgctgatgtattacttcctgcgggtgaaaaaagcgcatccggtgctgttaatcggcgtgacgtttgttctttctattgtttgttctgcattcggcattttgtaaatggaacgaggcaccgcgtctggcggtgcctctttacttaaggaatttcatcctgtgcaaacccttcaacaagttgaaaactatacggcgttaagtgaacgtgccagcgaatatttattggccgtgatccgtcgcaaaccggatgccgtgatttgcctggcgaccggagccacgccattactgacgtatcattatctggtagaaaaaatccaccagcagcaggttgatgtcagccagctcaccttcgtgaagctcgacgaatgggtggatctgccattaacgatgcctggtacctgcgaaactttccttcaacagcatatcgtgcagccgctggggttacgtgaagaccagctcatcagctttcactccgaagagataaatgagacagagtgcgaacgggtaacgaacctgattgcgcgcaaaggcggtctggacttatgcgttctcggattggggaaaaacggtcatcttgggctgaacgaaccgggagaaagcctgcaaccggcctgccatatcagtcaacttgatgccagaacacagcaacatgagatgttaaaaaccgcggaccgtcccgtgactcgtgggatcaccttaggcctgaaggatattctcaatgcccgcgaagttttgttactggtgactggcgaaggaaaacaggatgcgacagaacgttttctcacggctaaagtctctaccgctatcccggcttcatttttatggctgcataactatttcacatgcatgattgatgagatgtgtcgtcgttaactcgcctgctacaggcgttgcaacgctattcctgctgcgacgcctgtaatcactctccctgctgctccagcgcatacttatacagcgcatttttcttcacgccgtgaatttctgctgccagcgccgccgcttttttcagcggcagttctgcctgtagcagcgccagcgtgcgcagggcatcggcgggtaagtcttcttcctgtgctttatggccttcgacaatcagtaccatttcgcctttgcgacggttttcatcttctttgacccacgccagcagctcgccaacgggcgcgccgtgaatggtttcccaggttttggtcagctcacgcgccagaacgacgtagcgggattcgcctaataccgcaacgatatcttccaggctatctaacagacggtgggtagattcataaaaaatcagcgtgcgcggctccgcttcaatggcttttagcgcatcacggcggccttttgatttggcaggtaaaaagccttcataacaaaaacgatcggatggtaaacccgcggcgcttaacgcagtgatagcagcacacggcccgggtagcggcaccacgcgaatccccgcttcacggcaggtacgcaccagatggtagccaggatcgttaattagcggcgttccggcatcggaaaccagcgcaatgttttgcccctcttgcagcttcgccagcagcgtttcggctttttgttgttcgttatggtcgtgcagcgcaaacaaccgagcattaatcccaaaatgttgcagcaataaaccggtgtgacgcgtatcctcggcggcaatcagatcaacggcctgtaatacctccaacgcacgctgggtgatatccgccagattgccgattggcgtcggtacaatgtaaagctggccctgagaattatccgccgattggtgttgtttcattgtgtcgtccgtattgccgatttaatattgagcattgcgtaaaaaaaatatcactggatacattatggtaccctcaacattttctcgtttgaaagccgcgcgttgtctgcctgttgttctggcagccctgattttcgccggttgtggcacccatactcccgatcagtccactgcttatatgcagggcacggcgcaggctgattctgccttttacctgcaacagatgcagcaaagttctgatgataccaggatcaactggcaattactcgccattcgtgcactggtgaaagaaggtaaaaccgggcaggcagttgagttgtttaaccaactaccgcaagaactgaatgatactcagcgtcgcgagaaaacactgctggcggcagagattaaactggcgcagaaagattttgctggcgcgcaaaacttgctggcgaaaatcacacctgccgatttagaacaaaaccagcaagcccgttactggcaggcaaaaatcgatgccagccaggggcgtccttccattgatttactgcgcgcgttaattgctcaggaaccgctgctcggtgcgaaagaaaagcagcagaatattgacgccacatggcaggcgctctcctccatgactcaggagcaggcgaatacgctggtgatcaacgccgacgaaaatattctgcaaggctggctggatttgcagcgcgtctggtttgataaccgtaacgatcctgacatgatgaaagctgggatcgccgactggcagaaacgttatccgaacaacccgggcgcgaaaatgctgccaacgcagttggttaacgtaaaagcgtttaaacccgcatcgaccaacaaaatcgccctgctgttgccgctgaatggccaggcagcggtatttggtcgcactattcagcaaggctttgaagcggcgaaaaatatcggcactcagccagtggtggcccaggtagcagccgcacctgccgcagacgtagcagaacaacctcagccgcaaaccgtggatggcgttgccagcccggcacaagcttcggttagcgatctgaccggtgaacagcctgcggctcagtcggtgcctgtaagcgccccggcgacaagcaccgcagcggtaagcgcacccgcaaatccatccgcagagctgaaaatctacgatacctcatcacaaccacttagccagatcttaagccaggttcagcaggatggcgcgagtattgtggtcggtccgttgctgaaaaataacgttgaagagttgctgaagagcaacactccgctgaacgtgctggcactgaaccagccggagaacatcgaaaaccgcgtcaatatttgttacttcgcgctttcaccggaagacgaagcgcgcgatgcagcgcgtcatattcgtgaccagggtaaacaagcgccgctggtgctgatcccacgcagttcattgggcgatcgcgtagccaatgcgtttgcgcaagagtggcagaaactgggcggcggcaccgttctgcaacaaaaatttggttccaccagcgagttacgcgcgggtgttaacggcggttcgggtatcgctttaacgggtagcccgattactcccagagaaacaaccgactccggcatgacgaccaacaatccaacgctgcaaaccacaccaaccgatgatcagttcaccaataatggcggtcgtgtcgatgcggtgtacattgtggcaacgccgggtgaaatcgcttttatcaaaccaatgatcgccatgcgtaacggtagccagagcggtgcaacgctgtacgccagctcccgcagtgcgcaagggaccgctggcccggatttccgcctggagatggaaggcttgcagtacagcgaaatcccgatgctggcaggcggtaatctgccgttaatgcagcaggcgctcagcgcggtgaacaacgattattcgctggctcgcatgtatgcgatgggcgtcgatgcctggtcgttggcaaatcatttctcacaaatgcgccaggttcagggttttgaaatcaacggtaataccggaagcctgacggcaaacccggattgcgtgattaacaggaagttatcatggctacagtaccaacaaggtcaggtagtccccgccagttaaccaccaaacagaccggcgatgcgtgggaagcacaagcgcgtcgctggctggaaggcaaaggactacggtttatcgccgctaacgtgaacgagcgtggcggcgagatcgatctgataatgcgtgaaggccggaccaccgtttttatcgaggtgcgttaccgccgctctgcgctttatggcggcgcggcagccagtgtgacccgcagcaaacaacacaaattattacagactgcccgcttgtggctcgcgcgtcataatgggagttttgatactgtggattgccggttcgatgtggtagccttcaccgggaatgaggttgagtggattaaggatgcctttaatgaccactcataattaaggtttaaggattagcgtgcaagaaagaattaaagcttgcttcactgaaagcattcaaactcaaattgcggcggcagaggcgcttccggatgccatctcccgtgcagccatgacgctggttcagtctctgctcaatggcaacaaaatcctctgttgtggtaatggaacttccgctgccaatgcacagcattttgctgccagcatgatcaaccgtttcgaaacggagcggcccagcttacctgccattgcactaaatactgataatgttgtcttaacggcaattgccaacgatcgcttacatgatgaagtgtatgcaaaacaggtgcgggcgctgggccatgcgggagatgtattgttagccatttccacccgtggcaacagccgcgatattgtaaaagcggtagaagctgccgttacgcgtgatatgaccattgtggcattaaccggctatgacggcggtgaacttgcaggtttgttagggccacaggatgtggagatccgcattccttcgcatcgtagtgctcgcattcaggaaatgcatatgctgacggtaaattgcctgtgcgatctgatcgataacacgcttttccctcaccaggatgtttaaggagaatacatgaaggcattatcgccaatcgcagtccttatttccgcgctgctgttgcaaggttgtgttgccgctgccgtagtgggtactgctgctgtgggtaccaaagccgcaactgacccacgcagtgtcggcacccaggtagacgatggtaccctggaagtgcgcgtgaacagcgcattgtcgaaagacgaacaaattaagaaagaagcgcgcattaatgtaacggcctatcagggcaaagtgctgctggttgggcagtcaccaaacgctgaactttcggctcgcgccaaacagattgctatgggcgtagacggtgccaacgaagtgtataacgagattcgtcagggccagccgattggtctgggcgaagcgtctaacgatacgtggatcaccaccaaagtacgttcgcagctgttaaccagcgacctggtgaaatcgtccaacgtgaaagtgaccaccgaaaacggtgaagtgttcctgatggggctggtgactgaacgtgaagcgaaagcggcggcagatattgccagccgggtaagcggcgtgaagcgggtaactacggcgtttacgtttattaaatagcagcccttgtaatgcctgatgcgacgcttgcagcgtcttatcaggcctacaacgatgcaaaccgtaggtcggataaggcgtttacgccgcatccgacatgttttccctcaaatcaaaccaacagcgccagcccgccgacaatcacaccagacactgccaccatcgcccccgtcagccataaggctttcgtcgggaacgctttgcgcagcataatcagtgacggcaaactcaccgccgggagcgtcatcaacaatgccagcgccggagcagttcccatacctgccagcatcatcgtttgtacaatcggaatttctgctgccgtgggaatgacaaacaagcatcctgccaccgccatcgccaccacccacatcaggctgttatcgacagcaccatcggcatgggggaataaccagacgcgagcggcacccaacaccagtactgcaaggatgtaaaccgggatcgtactccagaaaagcgtccatagcgccctgccccagcggctaaaaaatcctccctgtgcttccggtatgtcaatttcgaccggtgcctgcgtttgcggtgtttcacgcacccatttttgcaccagcgtcgcaatcagcaacaccatcaccagccccgccaccagacgaatcgccgcaaaatcccagccgaggacgaaccccataaacaccagcgtcgccgggtttaacaacggattccccatccagaatgccagcgcaccgcccatcgacacctgttggcgacgcattcccgccgcgaccggagccgcacagcaggtacacatcatacccggcagcgaaaacagcgttcccagcagcgtgccgcgaaagcgcgattgcccaagcgtacgcaacaaccagtcacgcgggatcagcacctgaatcaacgaaccgaggatcacccccagcaccgccgctttccataccgcgagaaaatagatcatcgcgtaattcaacgccgcctgccacggattagcatccgcctgcgcaaggatagatttaccgatactgtgggtttcggcagcagtaaacgctttgccgtagtaaggttgccatttcacataccagagaccggcaatgacaacgagaaagaaaagcgcgggtttccaccactgaatgggcgttgccgcctgagatgaagactgaccagtcatagcattccccaggaataagttatgataattgagcgcgtgaatattacgctcactatcaattcttgggaataattattcagctcttttgcgtaattctgaagagcttaaaatcgtcacaccttcatgctcaggccgcatcgcctctgccagcatgacccgcgccacgtctctcgcatcaatggatttccagttaccgggtaacaaacggaacagcggcgcaaaaagcgtttcgttcatccgctgtttgctacgatcgcccagtaacatcgacgggcgagcaatggtcaatttcggccagttctgggcgattaatgcttcttccatctcccctttgacgcggttatagaaaaacggcgagtgggcattagcacccatagcactgaccaccagcatatgctgcgcaccgagccgccgcccggttaatgcggtatccaccaccaacgtgtaatcggcatgaataaacgcctctttgctccccgcttctcgccgcgtggtgccgagacaacaaaacacaatgtcgatgggatcggtgacctgcgccagcgcgtcagtcagttgcggatcatggggattaaacaccccgggcatatcgcccaacggacgtcgcgtcggcgcagcaatggcgttaactttcggttcattaatcaacatccgcagcaggtgaccgcccaccagccccgttgcgcctgtaatcagtacctgactcatcttcgctcctttacagaattgtctgccttgcgctccccggctcatgcaccaggcttaatagatcatgaggtaattatccccgattgtggaaaattcgcctcatccaatgcaacaacgcggaggaagcatgagtaagaaaatcgccgttttaatcactgatgaatttgaggattcagaatttacttcacccgcagacgagttccgtaaagccggacacgaagtgattaccattgaaaaacaagcgggtaaaacggtgaaaggcaaaaaaggagaagccagcgtggccatcgataaatccatcgatgaagtgacgcccgcagagttcgatgccctgctgctaccgggcggtcattcaccagattatctgcgtggtgacaaccgttttgtcaccttcacacgcgattttgtgaacagcggcaaacctgttttcgccatctgtcacggtccccagttgctgatcagcgccgatgtgatccttggtcgtaagctgaccgccgttaaaccgatcgtgattgatgttaaaaacgcgggcgcggaattttacgatcaggaagtggtggtcgataaagatcagctggttaccagccggacaccggacgatctgccagcgtttaaccgcgaggcgttacgcctgctcggtgcctgagttacgtagccaaatcatttttttaccaaagcccagcgtgttgtcggtgaatttgatttcatcgagccggatttcccataccggggccgacagcattctggcaaccggaaagcgacgattgtacgccttgcgtgcgaggtcgctttcctcgccttccagtctgcggatctcacctttaaactgcacgccgcgaattaacgctaccgttttcggctgaccgtttaccgttccggcaattgccgcctgcggcccgctcatctgcgcatgacgcgttttttcttccgtcaaaatgtagaaggcgactttctgcgcatcaaaaagataaaaggcattggcgcaccacagttccccttcctgctgcacacaccaggtgacaacatgttgttttgccagccaacggctgatggcggtgagtgtttccattgctgttctcttttatactgtgggcctgaccttaacatgcgacgcagacgatgacaccctggtttctttacttgatccgtaccgccgacaataagctttataccgggatcaccacggatgtcgaacgccgctatcagcagcaccaaagcggcaaaggggcgaaagcactgcgcgggaagggagaactaacgctggcgttttccgcaccagtgggcgatcgttcgctggcgttacgggcagaatatcgcgttaagcaactgaccaaacggcaaaaagagcgtctggtagcggaaggtgcagtgtttgcagaactgttgagcagcctgcaaaccccggagattaaaagcgattgaagtgctcgtgatactcaaccagaccagttacaccgttcagcgcgtcatccgctaaacgatgtacctggaaggcactttcagtgcccggccagcggcaacgcagatcgtgatgtgccgccagttcaaagccgaaacggctgtacagcgccggatcgcccagcgtcaccactgcggcatagccgaactcattaagcgaatcgagtccttcatagaccagttggcgtgccagcccctgtccacggtatttttcatctaccgccagcggtgccatgccgacccattgcaggtcttcgccctgcacatcaaccggactaaatgccacatagccaatgacctgaccttcgtcatctgtcgccaccagccccagcgtcagaaagccatcttcacgcagatcgtgaaccagcttcgcttccgcatcactttcgaatgaacgacgcagcagggcatcaatacccggcgcatcaatgggaatttctactcgaattagcatggttcacctaccgatgtctgtttggtttcaggcgcggttttcattcccgcctcaacaaaatccgccagttgcagcagcatcatgcgtaaggctttcggcatttgctccagttcaatggcgtccatcaggtttttcacatacagccccagctccgtatcgccttcaatcaccagccgacgctggaagaagagcgtatccggatcttgtttacgcgccgcaatcatcagcagatcgctggcgtcggcactaaaactcacatcagcttgcgcgttctggctaacgaccagtttgccattcaccaccgaggtaaaccattgcaggtcaatatcacgcacatgaatacttaaccagcgaccttcaagaaactccagctcgccatcatccagcgcctgacggaattgccagcttaagacctgctcaagaacctggcgttttagcgcaaatggcgtcagttttaccggtacactcaacagagatggccccaaatgcacaatacgggaacgcagtttatccaacacgagttttactccctgtttcaacaatcatcctattttgccatatcagaaaaataacatagcggtataaatcaacaattccatatgaaattgctgctaccaccaatacaactttaactgccttaaatcaaaaattgtcgcagcaaggttaactaaaatcccagttcgttaacatttttgcgttttgatagcgcaaccttcaggaaaaattatggagctgctctgccctgccggaaatctcccggcgcttaaggcggccatcgaaaacggcgcagatgctgtttatatcgggctaaaagatgataccaatgcccgtcacttcgccggccttaactttaccgagaaaaaattgcaggaagcggtgagttttgtccatcaacatcgccgcaaacttcacatcgcgattaacacttttgcgcatccggacggttacgcccgttggcagcgcgccgtggatatggcggcgcaactgggtgccgacgcgctgatactcgccgacctcgccatgctggagtacgccgccgagcgttatccgcatattgagcgccacgtatcggtgcaggcttcggcgaccaatgaagaggcgattaacttttatcatcgccattttgacgttgcccgcgtggtgctgccgcgcgtgttgtcgattcatcaggtgaaacaactggcacgggtcacacctgtaccactggaagtctttgctttcggcagcctgtgcattatgtcggaaggtcgttgctatctgtcgtcgtatttgacgggtgagtcgcccaacaccgtgggcgcgtgttctccggcccgtttcgtgcgctggcaacaaacgccgcaggggctggaatcccgcctgaacgaagtgctgatcgaccgttatcaggacggcgaaaacgcaggttatccgacgctatgtaaagggcgttatctggtgaacggcgagcgctatcatgcgctggaagaaccaaccagtctcaataccctggaactgctgccggagttaatggcggcgaatatcgcttcggtgaaaattgaaggccgccagcgtagcccggcgtatgtcagccaggtggcgaaagtctggcgtcaggctatcgaccgttgtaaggccgatccgcaaaacttcataccgcaaagcgcgtggatggagacgctcgggtcgatgtccgaaggcacgcagaccacccttggcgcatatcaccgtaaatggcagtgagaaaagcaatgaaatattccttagggccagtgctgtggtactggccaaaagagacgctggaagaattttatcagcaggccgccgccagcagcgccgacgtgatttatcttggtgaagcggtatgcagcaagcgccgggcaaccaaagttggcgactggctggagatggcaaaatcactcgccggaagtggcaagcagattgtgctctccacgctggcgctggtgcaggcatcctccgaactgggcgaactgaaacgctatgttgagaacggtgagtttctgattgaagccagcgatctcggcgtggtgaatatgtgcgctgaacgcaaactgccgttcgtcgccgggcacgcgctgaactgctacaacgcggtgacgctgaaaatattgctcaaacagggcatgatgcgctggtgtatgccggtggagctttcccgcgactggctggtgaatctgcttaatcagtgcgatgagctgggcattcgtaaccagtttgaagtggaagtcttgagctacggtcatctgccgctggcctactctgctcgctgctttaccgcgcgttcggaagaccgcccgaaagatgagtgcgaaacctgctgcattaagtatccgaacgggcgcaacgtgctgtcgcaggaaaaccaacaagtgtttgtactcaacggcattcagaccatgagcggctacgtttacaacctcggtaacgagctggcatccatgcaggggctggtcgatgtggtccgcctgtcaccgcagggtactgacactttcgcaatgctcgacgccttccgcgccaatgaaaatggcgctgcaccactgccgttgacggcaaacagcgattgtaacggctactggcggcggctggccgggctggagctgcaagcgtaagtatatagctcactttgttaacaactttaactactctttaatgcagtattaaagattaatcggtaacaaagtgagctgttatgactgataaaaccattgcgttttcgttactcgatctggcccccattcccgaaggttcttcagcgcgagatgcgttctcccactctctcgatctcgcccgtctggctgaaaagcgcggctatcatcgctactggctggcggaacaccacaatatgaccggcattgccagtgctgcaacgtcggtgttaattggctatctggcggcgaataccaccacgctgcatctggggtctggcggcgtgatgttgcctaaccactcaccattggtgatcgccgaacagttcggcacgctcaatacgctctatccggggcgaatcgatttggggctgggtcgtgcaccgggtagcgatcagcgaaccatgatggcgctgcgtcgtcatatgagcggcgatattgataatttcccccgcgatgtcgcggaactggtggactggtttgacgcccgcgatcccaatccgcatgtgcgcccggtaccaggctatggcgagaaaatccccgtgtggttgttaggctccagcctttacagcgcgcaactggcggcgcagcttggtctgccgtttgcgtttgcctcacacttcgcgccggatatgttgttccaggcgctgcatctttatcgcagcaacttcaaaccgtcggcacggttggagaaaccgtatgcgatggtgtgcatcaatattatcgccgccgacagcaaccgcgatgccgaattcctgtttacctcaatgcagcaagcctttgtgaagctgcgccgcggcgaaaccgggcaactgccgccaccgattcaaaatatggatcagttctggtcgccgtccgaacagtatggtgtgcagcaggcgctgagtatgtcgctggtgggcgataaagcgaaagtgcgtcatggcttgcagtcgatcctgcgcgaaaccgacgccgatgagattatggttaacgggcagattttcgaccaccaggcgcgcctgcattcgtttgaactggcgatggatgttaaggaagagttgttgggatagtatgtcttaacgcgggaagccttatccgagctggcaacgctgtcctacgtaggcctgataagcgaagcgcatcaggcattgtgtaggcagcagaaatgtcggataaggcaccgctgattactgatacaccggcagcacattaaagctcgataagatatggaccagtgcgttgccaacgccaaataccagaatcagcataatcatcggcttgccgccccatacacggaatttcgggctaccaaagcgtttacgcgatgcgcgggccaacagcgccggaacaattgccgcccagatggtagccgctaagccagcataaccaatggcgtacaggaatccgttaggaaacagcagaccacccacaacaggcggggcaaaggtcagcaacgctgttttcaaacggcccatagccgagtcgtcaaaaccaaacagatctgccagatagtcaaacaaacccagcgttacgccaaggaacgaactcgctaccgcaaagtttgagaacacgaccagtagaagatccagactacggctgttcagtacgccgcttaacgcctgtaccagcacatcaatattaccgcccttctcggcgataccgataaactccggacgcgggatgttacccatcgtcgccagcaaccagatggtatacagcgccagcgccatcagcgtaccgtacaccaggcatttcacgatggttttcggatctttgccgtaatacttcatcaggctcggtacgttaccgtgataaccaaacgatgccagacagaatggcagtgtcatcagcagatacggcgcataagacgcattgctttcggcgacgttgaacaatgtcgcaggctgcacatgccccagcaggctgccgaaggtgaggaagaaagtaatgactttcgcccccagcacaattgctgtcatccggctgacagctttcgtactcaaccacaccacgaacgctaccagcagtgcaaaaccaaatccagctgcccgtgcagggacgttcagcgacatctccgcgaaggtgtgatgcagaatcgaaccgctggcagaaatataggcgtaagtcaggatatagagcacaaaggcaatggaaatgccgttgactacgttccagcctttgcccagcaaatctttggtgatggtgtcaaagctagaaccgattcgataattcaggttagcttccagaatcatcaagccggaatgcagcatacagaaccaggtaaagatcagcgccgccattgaccagaagaaccacgccccggacatgaccacaggcagagaaaacatccctgcgccaataatggtgccgccgataatcaccacgccgccaagcagcgacggtgacgtttgggtggtggttagtgttgccatgagggcttctctccagtgaaaaatagtgcgactgtgttgttatgcattgcactgtaccagtacatgagtacaaaaaacagaaaaaaagccccgatggttaaaatcggggctgtatatattattttacagattgtgttcgctgttcagcgatgattacgcatcaccaccgaaacgacgacgaccggtagagtcatcacgacgcggtgcgcggccttcacgacgttcgccgctaaaacgacgcccatcaccacgacccccttcacggcgttcaccgctgaagttacgaccgccttcacgacgttcgccaccgaaaccacgaccaccgccacgacgctcaccaccagtatgcggctgtgcatcgcccagcaactgcatgttcatcggcttgttgagaatgcgagtacgcgtaaagtgttgcagcacttcacccggcatacctttcggcagttcgatggtggagtgagaagcaaacagcttgatgttaccgatgtaacggctgctgatgtcaccttcgttagcaatcgcgccaacgatatgacgaacttcaacaccatcatcgcggcccacttcaatacggtacagctgcatatcgccaacatcacgacgttcacgacgcggacgatcttcacggtcgccacgcgggccacggtcgttacgatcgcgcggaccacggtcatcacggtcacggaattcacgtttcggacgcatcggcgcatctggcggaacaatcagagtacgttcaccctgtgccattttcagtagtgcggctgccagagtttcgagatccagctcttcaccttcggcagtcggctgaattttgctcagcagtgcacggtattgatccagatcgctgctttccagctgctgctgtactttagcggcaaatttttccagacgacgtttgcccagcagttctgcgttcggcagttctacttccggaatggtcagcttcatggtgcgttcgatgttgcgcagcagacgacgctcacggttctcaacgaacagcagtgcacgaccagcacgacctgcacgaccggtacgaccgatacggtgaacgtaagactcagaatccatcgggatatcgtagttaaccaccaggctgatacgctcaacgtccaggccacgggctgcaacgtcggtcgcaatcaggatgtccagacgaccatctttcaggcgttccagtgtctgctcacgcagcgcctggttcatgtcaccgttcagcgcggcgctgttgtagccgttacgctcaagagcttctgccacttccagagtcgcgtttttggtacgaacgaagataatcgccgcatcaaaatcttccgcttccaggaaacgtaccagtgcttcgtttttacgcataccccagacagtccagtagctctggctgatgtcaggacgggtagtcacgctggactgaatgcgcacttcctgcggctctttcataaagcggcgggtaatgcgacgaatcgcttccggcatggttgcagagaacagagcggtctgatgaccttccgggatctgcgccataatggtttcaacgtcttcgatgaagcccatgcgcagcatttcgtcagcttcatccagaaccagaccgctcaatttagagaggtccagagtgccacgtttcaggtggtccagcagacggcccggagtaccgacaacaatctgcggcccctgacgcagggcgcgtaattgcacgtcataacgctggccgccgtacagggcaaccacgtttacgccgcgcatgtgtttagagaaatccgtcattgcctcagcaacctgtaccgccagttcgcgggtcggtgccaacaccagaatctgtggtgctttcagctcaggatcaagattctgcagcagaggtaaagagaatgctgcagtttttccgctccccgtctgggccatacccagaacgtcgcggccattcagcagatgtggaatacactctgcctgaattggagatggtttttcgtaacccagatcgttaagggcttcaaggataggagccttcaggcccagatctgcaaaagtggtttcgaattcagccatgtagtacgtgtgcctcaaaattaatggcggccagtctacataactcatcatgaaattgatcagcaattttcattgaaaagtgtgaaccggctcaaagtaggtgtattaacgaacaacaacgccctcacccgttaaggtgatggcaatcaaaaaagattacgggctgatgtgtacgtcagctattgctggtccgattctgccaggtcatcttggtcctggcccaggagcgataattccaacaatgcgtatcggtgctcaacaaagttatgaacgttgttggcaaccgccagtttgaacagtgccgtggcgctgtccaaatcccccagacttaggtagtacttacctaaatagaagttggtttcactgagatgctcagcgagcgaggtgttatccgttgcgtccgccttgagcctttccattaacgtttgttcgctaatgttgcccaggtagaactcgacaatgttccatccccactgttccttatccgatttttcgaagtgctgtttcaacacttctttagcctgcttctcatcgagcttctgctcggcgagataaagccacagactacggaaaggatcattgggatcgtcttgataaaacgccagcagatcatcttgcgctaacttgtcacgaccgccgtaatataatgcgatcccgcgattcaagtgcgcgtagttgtaagttggatcaagctcaagtacagaatcaaacgcttcataggcagcatcaaaattgcctgcctgcgttaaatatatgcctaagtaattgaatacttcaggcatatccggtcggattgccagcgcttgcgaaaaatcgttacgcgctaatgccctcagaccgagactatcatacaacactccgcgctcatataaaagctgtgcgcgttcgtcatcggttaaagcccgactggcaaggatctgttccatacgtgccagaatcacttcctgctgtaaagtcggttgcaatggtaccgcgagaacttcacttttacgccaggaagtattactgcatcctgcaagcgtaagtgctgtcgcaacgaaacaccagcgcaaaaaaggcttcatttcccactcccgaagaccacggttgaatgaacgtcctgttcccggttgctaacaaggcgtcctgcccggttaaaagccccccgccgcagcggagggcaaatggcaaccttactcgccctgttcagcagccggagcttccggtgctgcagcaggttgagactgctcagtcgcttctttaatgctcagacggatacggccctggcgatcaacttccagcactttcaccggtacttcctgacccatctgcaggtaatcggtcactttctcaacgcgtttatcagcgatttgagagatgtggaccagaccttctttaccgccaccaatggcaacaaatgcgccaaagtcaacgatacgggtcactttaccattgtagacgcggcccacttcgatttctgcagtgatctcttcgatacgacgaatcgcgtgtttcgctttctcgccgtcggtcgctgcaatcttcacagtaccgtcatcttcaatttcgatggtggtgccggtttcttcggtcagagcacggattacagaaccgcctttaccgataacatctttgatcttgtccgggttgatcttgatggtatggatacgcggtgcgaactcagagatatcgccacgcggcgcgttgatcgcctgttccattacccccaggatatgcagacgcgcacctttagcctggttcagtgcaacctgcatgatctctttggtgataccttcaattttgatatccatctgcaatgcagagataccgtcacgggaacccgcaactttgaagtccatatcgcccaggtgatcttcgtcgcccaaaatgtcagacagtacaacgtagttgtcgccttctttcaccagacccattgcgatacccgcaacggcagctttgattggcacacctgcgtccatcagcgccagagacgcgccgcacacggaagccatagaagaggaaccgttggattcggtaatttcagacacaacacgtacggtgtacgggaatttgtccatatccggcattactgccagcacgccgcgcttcgccagacgaccgtgaccaatttcacgacgcttcggagaaccgaccatgccggtttcgcctacggagtacggagggaagttgtagtggaacaggaaggtatcggtacgttcgcccatcagttcatcaagaacctgcgcgtcacgagcagtacccagcgttgcggtaaccagcgcctgcgtttcaccacgggtgaacagcgcagaaccgtgagtacgcggcagcacaccagtacgcacatccagaccacggatcatatctttttcacgaccgtcgatacgcggttcgcctgccagtacgcggctacgaacaacatttttctcgatagcgtgcagaatttcacccagttcgttttcgtccagggtttcgtcttcagcaagcagtgtcgcgatggtttcagatttgatgacatcaacctgcgcataacgctcttgtttgtcggtgatgcggtaagcatcgctcagacgagcttcagccagcgcagcaacgcgcgcgttcagcgcttcgtttaccggctccggctgccaatcccaacgcggtttaccggcttctttcaccagttcattgatgttctgaataacaacctgctgttgttcatgaccgaagactactgcgcccagcatctggtcttcgctcagcagttcagcttcagattcaaccatcagtacagcggcttcagtacccgcaacaaccagatccagtttgctctctttcaactcgtcctgagtcgggttcagtacgtactggtcattgatgtaacctacgcgggcagcaccaatcggaccattgaacggaataccagacagagacagtgctgcggaagcaccaatcatcgcgacgatatccgggttaacttgcgggttaacagaaaccacggtggcgataacctgaacttcgttgacgaagccttccgggaacagcgggcgaatcgggcggtcaatcagacgcgcgatcagggtttcgccttcgcttgggcggccttcacgacggaagaagctacccgggatacgaccagcagcgtaggtacgctcctgatagttaacggtcagcgggaagaagtcctgacctggtttggcttttttctgaccaacaacggtaacaaataccgcggtgtcatccatgctaaccataacagcggcagtagcctgacgagccatcatgccggtttccagagtcacggtgtgttggccgtactggaatttacgaacgatcggattaagcaatgtaatatcctttctctttcttagacagtaccttacggtactggtgttaatacccgatcttctgcgcatcctcgcgactaatgacaaccctaacccagctctatgtgggtaaagcctctcattagccgcgcgaacctctgcaacggaagatcattcatagcaacaatacattagtttccagtgaattgctgccgtcagcttgaaaaaaggggccactcaggcccccttttctgaaactcgcaagaattagcgacgcagacccaggcgctcgatgagctgggtgtaacgtgctacgtctttacgtttcaggtagtcgagcagtttacgacgctgagaaaccatgcgcagcagaccacgacggctgtggtgatcttttttgtgctctgcaaagtggccctgcaggtggttgatctgtgcagtcagcagtgctacctgaacttcggtagaaccggtgtcgtttgcgtcacgaccaaactcagaaacgattttagctgttgcttcagtacttagagacattttaaaactccaaagtatatagaatgaaaggacgccgatctctaattcagcgatcccagtgtacgttacgcaaagtgttaaacaatttacgcgacgttaagcggcagtattctactcgtagcgacctgttatcgcaagacggttaacattacgccgggtattcaaccaccaggcgacgaggcgcaacgcggccttcatcgtcaatttcgcccataccgataaacttgccgttctcaccctctgtaacgcgaaccagtccttccagcggcgcaccggatgtacgaactgggttaccatttttgaagtaaacagaagacgttaacggaagattcaccactgggtagtccgaagctggactgtccattggcatcagtaatggatcaagtaactccgcagccggaatatcctgctgttcggcttgctcaaccagttcacgcagatgttccagggtcaccatccgttcaaccggatatttacttaccgccagacgacgcaagtaaataacatgcgcgccacaaccgagtttttcgccgagatcgtcaatgatagtgcggatataagtgccttttgagcagtgaatttccagctccagctcattgccttcatggcgaataaacagcaattcataaacggtaatcgggcgcgcttcacgcggaacttcaatgccctgacgcgcgtattcgtacagttttttgccctgatatttcagtgctgaatacatcgaagggatctgttcgatatcgccacggaaggtatccagcgccgccgccagttgctctgcactaaaggttaccggacgttcttcaacgatttgtccgtcggcatcagaagtatcggtacgctgtccaagacgcgcaatgacccgatagcgtttgtcggagtccagcagatactgggaaaacttcgtcgcttccccgaggcaaattggcaacatgccggtcgccagcgggtccagcgcaccggtatgcccggcacggttggcgttataaatccgtttcactttttgcagcgcatcgttgctggacatcccctgcggtttatccagcaacaaaacgccgttaatgtcgcgaccgcgacgacgaggacgactcattagtcctccttgctgtcgtccgggttaacacgacgttcttcgtcatgtttgaccacgctggtcaccaggtttgacatgcgcatcccttcaaccagagagttgtcgtagaagaaggtcagttccggcacgatacgcaggcgcatcgctttccccagcaggctgcggatgaaaccagaagcttcctgcaacgctttgatgcccgctttaaccgcgtcttcatctttgtcgttgaggaacgtcacatatactttggcatacgccaggtcgcgagacatttcgacaccggaaacggtggtcatcatgcccagacgaggatctttaatttcacgctgcaggatgagagcgatctctttttgcatttcctgcgctacgcgctgcgggcgaccaaattctttcgccataataaattctcctgacaaaaaaggggctgttagcccctttttaaaattaatttcaggtggaagggctgttcacgttggcctgataagacgcgccagcgtcgcatcaggcaatccatgcaggatgcgacataaacgccttatcccgcatggaaccctaaaaaccttaagcgatagtacgttggatctcgatgatttcgaatacttcgatcacatcgccagtgcggacatcgttgtagttcttaacgccgataccacattccataccgttacggacttcgttaacgtcatctttgaagcgtcgcagggactccagctcgccttcgtagataaccacgttgtcgcgcagaacgcggatcgggttgtgacgtttaaccacaccttcggtaaccatacaacctgcgatagcaccaaatttcggtgatttgaacacgtcacgaacttccgccagaccgataatctgctgtttcagttccggagacagcataccgctcatcgccgctttcacttcgtcgatcaggttatagatgacggagtagtaacgcagatccaggctttccgcttcaatcactttacgtgcagaggcatcagcacgtacgttgaagccaaccaggatggcgttggacgccgcagccagggtagcgtcggtttcggtgataccacctacgccagaaccgatgatcttcactttaacttcgtcagtagacagtttcagcaaggagtcggaaattgcttccacagaaccctgtacgtctgccttcaggacaatattcacttcgtgaacttcgccttcggtcatgttggcgaacatgttctcgagtttagatttctgctgacgcgccagtttaacttcgcggaatttaccctgacgatagagtgcaacttcacgcgctttcttctcgtcacgtacaacggtaacttcatcacccgcagccggtacgccggacaggccaaggatttccaccggaatggacggacccgcttccagcacttcctgacccagttcgttacgcattgcacgaacacgaccgtattcgaagccacacagaacgatatcgcccttgtgcagagtaccttcacgtaccagaacggtagcaaccggaccacgacctttatcgaggaaggattcgataaccgcaccgctcgccatacctttacgtaccgctttcagctccagaacttccgcctgcagcaggatagcatccagcagttcatcaataccggtacccgcttttgcagatacgtgtacgaactggctttcgccgccccactcttctggcaggatgccgtactgggagagttcgttcttaacgcgatccggatcggcttctggtttatcgattttgttcacagcaaccaccaccggaacacccgccgctttcgcgtgctggatagcttcgatggtctgcggcattacaccgtcgtctgcagcaacaaccaggactacgatgtccgttgcctgcgcaccacgtgcacgcattgaagtaaacgcggcgtgccccggggtgtccaggaaggtgatcatgccgttttcagtttcaacgtggtatgcaccaatgtgctgggtaatgccgcccgcttcgccagaggccactttcgttgaacgaatgtagtccagcagagaggttttaccgtggtcaacgtgacccatgatggtcacaaccggcgcgcgcggttcagccgcagcacccgtgtcacggtcgctcattaccgcctcttccagctcgttttcacgacgcaggataactttgtggcccatctcttcagcaaccagctgtgcggtttcctgatcgataacctggttgatggttgccattgcgcccagtttcatcatcgctttgatgacctgagagcctttaaccgccatcttgttcgccagttcgccaacggtgatggtttcgccgatcacaacgtcacggttaacggcctgagctggcttctggaagccttgctgcagcgaagaacctttacgttttccgcccttaccgccacgtactgctgcgcgagcttcttcacgatcagcttttgattcagcgtgtttgttgcctttcttcggacgcgctgctttcgcgttacgaccacggccacggccgccttcgacttcacgatcgctttcgtcttctgcctggcgagcatgttgagaagtagtgacgtgataatcgctggaatcttcagtcggttccgcgttatcagtccatttgttttcttccgccatacgacgtgcttcttcagcaacgcgacgtgcttcttcttcgagtttacgacgcgcttcttcttcggctttacgcttgagctctgcagcttcctgctcacggcgggctttttcagcctgggcgtttttagtcatatcgtcttgttgattgctcactttgtctttttccgcagcttcacgtttcgcttgttcagcagcttcacgcttagcttgttctgcggcctcacgttcagctttttgttgcgcctcgcgtttagccgattcttctgcctcacgacgggcttgctcttccgcttcacgctgcgcttgctcttccgctgcaaggcgctcagcctcttgcggatcgcgtttcacaaaggtgcgtttcttgcggacttcgatttgtaccgatttgctttttccaccggtaccaggaatgttaagggtgctgcgtgttttacgttgcagcgtcaatttgtccgggcctgaatttttctgattcaggtggtcaatcaaagtctgtttctcttgtgcagacacagagtcgtcagcagacttccggatacctgcatcagcaaattgctgtaccaggcgttccacggaggtctgtcgctctgcagccagcgttttaatcgttacatctgtcatgctgttccttcctgctacagtttattacgcttcgtcaccgaaccagcaaatattacgggcagccataatcagtgctccggctttttcgtcggtcaacccttcgatatcagccagatcatcaatgccctgttcggcgagatcttccagcgtacaaacgccacgggcggccagtttgaatgccaaatcacgatctaccccttcaaggttcagcagatcgtcagccggtttgttatcaccgaggctttcttcctgggcctgtgcaatggtggccagtgcatttttagcacgctcgcgcagtgcttcaacggtcggctcatcaaggccttcgatttccaacagctctttcatcggcacataggccagttcttccagcgtcgagaagccttcttctaccagaacagtcgcgaagtcttcatcgatatcgagatatttggtgaaggtgtcgatcgctgcgtgcgcttccgcctgatgcttagcctgcaggtcgtcaacggtcatcacgttgagttcccaaccgctcagctgcgaagccagacgcacgttctgaccgttacggccaatcgcctgcgccaggttaccggcttcaacggcgatatccatggtgtgtttatcttcatccaccacgatagaagcaacgtctgccggtgccattgcgttaatcacaaactgcgccgggttatcatcccacaggacaatatcgatacgctcgccgcccagttcagtagaaaccgcctgaacacgcgcgccacgcatacctacgcaagcacctaccggatcgatacgtttatcgttggttttcaccgcaattttcgcacgagatcccgggtcgcgagccgctgctttaatttcaatcacttcttcgccgatttccggcacttcaatacggaacagttcgatcagcatttccggcttggagcgggtgacgaacagctgcgcgccacgcgcttccgggcgaacggaatagagcacgccacgaacgcggtcgccagggcggaagttttcacgcggcagcatatcttcgcgcaggatcacggcttcagcgttgttgcccaaatccagagagatgttgtcgcggtttacttttttcaccacgccggtgatgatttcaccttcgtgttcacggaactgatcaaccaccatcgcacgttcggcttcacgcactttctgcacgataacctgttttgccgtctgggtagtgatacggtcaaaggtaacagactcaatctgatcttcaacgtaatcgcccaggttcaggctttcatcttcataacgtgcggcttcaagggtgatttccttggtcggctgggtgacttcatcaacaactaaccagcgacggaaggtgtcaaaatcaccgcttttgcgatcgatctgtacgcgaacgtcgatttcttgttcatattttttctttgttgctgtcgccagcgcgctttccaatgcttcgaaaatcttctcgcgaggtagcgccttttcattggatacggcttcaactacagccaaaatttctttgttcatcgcgggcttttcacctcatccagactattaaaagtggggaaccaggttcgccttctggatattactcagcgcgaacacttcatctttaccttcgacggtaactgtgatcatttcaccgtctaccgctttgataacgccctgccatttacgacggttttgtaccgccatacggagaaccagagtcacctcttctccgacaaaacgggcgtagtgttcagccgtgaacagtgggcgatcgagacccggtgaggagacttccaggttataagcaacggtgatggggtcttcaacatccagcacagcacttacctggtggctcacatcagcacaatcatcaacattgatgccatcttcactatcaatatagatgcgcagtgtggatgtgcgaccgcgaataaattcgatgccaaccagttcaaaacccagggcctcaactggcgcagtaatcatctctgttaatttttgctctaatgtggacaagcccacccccaagacataaaaaaagggcctaaagcccagttattctgtagtcagataacaaaaaaccccgataaatcggggctttatataactgaaccctataaccgcaactgcggtctggagcactttccagaaggattttttcaaatcccactacgaaggccgaagtcttcacagtatatttgaaaaaggactctaagggaaagtggttgcgggggccggatttgaaccgacgaccttcgggttatgagcccgacgagctaccaggctgctccaccccgcgcctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcacgtgaatgaatatccagttcactttcatttgttgaatacttttaccttctcctgctttcccttaagcgcattattttacaaaaaacacactaaactcttcctgtctccgataaaagatgattaaatgaaaactcatttattttgcataaaaattcagtgagagcagaaatccaggctcatcatcagttaattaagcagggtgttattttatgacgacgattctcaagcatctcccggtaggtcaacgtattggtatcgctttttccggcggtctggacaccagtgccgcactgctgtggatgcgacaaaagggagctgttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccactggtggactgacctatttcaacacgacgccgctgggccgcgccgtgaccggcaccatgctggttgctgctatgaaagaagatggcgtgaatatctggggtgacggcagcacctataaaggaaacgatatcgaacgtttctaccgttacggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcttactccacggactccaacatgcttggtgcaacgcatgaagcgaaggatctggaatacctcaactccagcgtcaaaatcgtcaacccaattatgggcgtgaagttttgggatgagagcgtgaaaatcccggcagaagaagtcacagtacgctttgagcaaggtcatccggtggcgctgaacggtaaaacctttagcgacgacgtagaaatgttgctggaagctaaccgcatcggcggtcgtcacggcctgggcatgagcgaccagattgaaaaccgtatcatcgaagcgaaaagccgtggtatttacgaggctccggggatggcgctgctgcatatcgcttatgaacgtctgctgaccggtattcacaacgaagacaccatcgagcagtatcatgcacatggtcgtcagttgggccgtctgctgtaccaggggcgttggtttgattcccaggcgctgatgctgcgggactctctgcaacgctgggttgccagccagatcactggtgaagttactctggagctgcgccgcgggaacgattattcaatcctgaataccgtctcagagaacctgacctacaagccagagcgtctgacgatggaaaaaggcgactcggtgttctcgccagatgatcgtattggtcaattgaccatgcgtaatctggatatcactgatacccgagagaaactttttggttatgccaaaactggcctgctctcctcctctgccacttcaggcgtgccgcaggtggagaatctggaaaataaaggccagtaattcgacatcaaccctgcccttcaggggtggggttaccttgcttatcctcagtaaattcctttcttagcatcacaaaatcgaaaacatcatggtttgcatctacaacccgtgagtctcctttatagtgtgcaatcacttcctccagcgtttgcggctgttccggctttgttacccccatccacgcattaataaggtaattattgtacgcagtggaaaagatatcgttttccgttgtgcgatccacgccatccccaagaacggggctataccagataaacatagggacatgatatgcctgctggctagcctccctacctccatgaaaatagacgttcttcttcgtagggtcgcgttccaggccgtggtcggcaaaatacatgaccgaggcgcggcgatcttttaataattcaaaaacctgacctagcaaactatctgtgtaatgaatggagttgtcatagcaggcatcctgatcgtcctgcggttgaaacacggcgctggattgcggataggcgctacaagccggttcatggcttccatttaaatgaagaacaatcagttttttttgctgcgtcttttgctgtaacgcttgcgataaatgcggcaacaacaattcatcaaatcctctgacatagactgtttccatggcgcgcatggcgatactggtaactgctgtaccattctgccggaaatcggattgcgagcttagccagaaagtctgaaatcctgcttgattagccatattaataatgttgtccgggtaattatgaatgtcatgactcaaaacagaatcagcagttaaagaaaggggaaccgacagcgcagtgtaaggtgcaccgcttattgcttgattaaacagtttgatctgctttctttgtgcttcgacttgcggtgtcgtagagcgtgtatatccatacaaagacatattgtcgacacgtacagactcccccacaatcaacacgtaggtatcaatacctgtatccctgactgatagttgaaaatacggcaccgtgtttgcaattgagagtaatctttgatgctctttcgctgctaaagcaaaataattgagattgaaaaacggcgtataggtagcaaatcgcgacgctagtatatatggactgaacgcctctttattttttgcatctttataagcaaattgacaagcggaaaataaactgcccgaaatgacaatcagcaataatattcctgtcactttttttgtcggcaaggaaacatcatattttattattactgcaaaaaaaagaagggataaaaaggcaaaagcacatagataagggatatacattcccagcattttgacaacttcatccggatcactctgcagcacactaatcgcaaatccatcattgaaagttgtaccaaagatacaccatgaatagaggctaatactcatatctgccgcagtcagtaacacaaatggtacggcaataagcaggcgaagcggaagggatgatatacgtttaacaaccaggatggtcagaacgaaaaacagcaatcgctgaaccatatgtgctccggaagaggcgactaagttcgtaataccaaaaacaataacacaaagatacaacaaccaatgagatttaaaacttctaacaaatttgttgaatactgtcatccagaaatccaagttcacaaccaatataaacaattatcaacaatgttcaattttatatcagacatgtttttcaactctgatccatatcagaccgaaacactgttagttttttctttttaaatgatgcggccattgttctcagtaattaaataacattatcaatgcgtctctaaacattacgcagaacgtagccatcagtagttatactgacaggagcaggatggtttatcgagaagtaaacatatccgtattcgtaccggaactggagttgacacaataaagtgccaattatgtcagcagaagggaaaagtttataactaaggcgtaccggcaccatcgtttcaaagtaccagctacgagtaaagcaactggacgagatacagatacctgacaaccattcctcagaccaggaccaaaacgaaaaaagacgcttttcagcgtctttctggaatttggtaccgaggacgggacttgaacccgtaagccctattgggcactaccacctcaaggtagcgtgtctaccaattccaccacctcggcacggatactactttttagttcgggatatcgctggtcggcttagccggagcagctggctgagtttgttcggttttcgccggcgcactcaggttttcccattcgctacctttattggttttgttgctattgatgttacccagcaccagactgatgatgaagaataacgttgccagcagcgctgtcatgcgggtcatgaagttaccagaaccacttgaaccaaacagcgtagcggaagcgcctgctccgaaggaggctcccatatcagcgcctttaccttgctgcagcatgatcagaccaacaaggccaattgccacaataaggaaaactactaaaagagcttcgtacataatcaacctgttccttgcggagttgccgcgtaccaatgcttcaaccaataaagcgggagtttttaatctttcccactgaagcgggtgtgaatactaaccaaagcgaatgaccttcgcaagggcaattttattgcattgtatcaactgcggaaaaaaacagcaaaaccgatgtgttcgctgagaaaaaaggcgacaatcgccgcctttttagccagccatttatcgttttaaacggcttttactgcatcggcgatgcggtgtgcaaattcagtcacctgcgcttcgtcttcgccttccaccatcacgcgaattaacggttcggtgccggatttacgcaacagcacacgtccacggctacccagcgcagcttcaacttctgcggtcacagctttgactgactcatgctccagcggatcgccgctgcctgctgtgtaacgcacgttaaccagaatctgcgggaacattttcatgccgctgcaaaggtcgtgcaggctcatatggttacgcgccatcgccgccagcacctgcaagccagcaacaatgccgtcaccggtagtggttttatccagcaggatcacatgaccggagttctctgcaccgatacgccagcctttctcctgcattttttccagtacgtaccggtcacccactttcgcgcgcgcaaatggaatacctaactgtttcagcgccagttcaagccccatgttgctcatcaatgtacccacagcacctccacgcagctggccctgacgaagaccctcacgcgcgatgatatacatgatctgatcgccatcgactttattgccttcatggtcaaccataatcacgcgatcgccgtcgccgtcgaaggcaataccgagatccgctttttcagccagcacacgagcctggagcgcgcgaacgtcggtagcccccacttcggcattgatatttacaccgttcggctcacaaccgatagcgataacgttcgcccccagttcacgcagtacgttcggcgcgatgtggtaagtcgcaccgtttgcacaatccaccacaatcttcagttcactgaggctaagttcgttcgggaacgtggctttgcaaaactcgatataacgacccgcggcatcaacgatacggctggctttacccagttctgccgaatcaacacaactgatctctttttccatttccgcttcgatggcttcttcaactgcatccggcagcttagtaccgtcaatagaaaagaatttaatgccgttatcgtagaatgggttatgcgatgcagaaattacaattccagcctctgcgcggaaggtacgcgtcagataagccacggccggtgttggcatcgggccagtgaatagcgcggaaagaccggctgccgcaagccccgcttccagtgctgactccagcatatagccagaaatacgcgtgtctttaccaataataatcttacgggagccgtggcgcgccagcactttacccgcggcccaacccagcttaagcacaaaatcaggtgtgatcggcgcatcccctacacgaccacgaatcccatcggtaccgaaatatttacgattactcatagcgtttgttttcctttgcagacagagtggcttccaccacccgcatcgcttctacggtttctttgacgtcatgaacacgaatgatgtgcgcgccttgcattgcggcaatgaccgcacaggccagactaccgctcaggcgctcggacggccccacgttcagcaattgcccaatcatcgattttcgtgacatacccaccaacagcggcaggttgaaatggtgaaattcagccaggcgcgccagtaatgaatagttatgggagagatttttaccgaaaccgaatccggggtcgagcaacaatttctcttttgcgatacccgcctgctcgcaacgtgctatttgctcaataaagtagcgattcacttctgcaaagacatcgtcatacttcggcgcttcctgcatggtttttggatttccctgcatatgcatcagacaaaccggtaaaccggtttctgcagccgcctccagagcaccaggttcggaaagggagcggatatcgttaataatgtgagcgccaactttcgctgactcacggatgacttctggtttggatgtatctaccgagatccagacttcgaagcgttgagcaattgcctcaaccacaggaataacacgttgcaactcttcttcaacgctaacttccgccgcccctgggcgcgtggactcgccaccaacgtcaatgatcgtcgcgccagcgttgatcatcagattcgcatgtttcaccgcatctaacagcgagttatgcgtgccaccatccgaaaaggaatcaggcgtgacgttgaggatccccattacgtgaggatggctaaggtccagtgaagtaccctgggcaaagagtttcatgatgttatccctggtatgaattgataagaaaaaaccccggagcacgccccggggttttcggtacaaatacagtcatctgatacgggaacttacttgtcgcctaactgctctgacatggtgttacccgggttcggcgtacgcggttcatcaaccggacgaggagcctttggactaccattgtcgccagaattgttagaagcgcctggttcttcccagcccgctggcggacgtacatcgcgacgtgccatcaggtcatcaatctgcggtgcgtcgatagtctcatatttcatgagagcatctttcatcgcatgcagaatatccatattgtcggtcagaagctgacgcgcacgattatagttacgctcaatcagtgctttcacttcctggtcgatgatacgtgcagtttcatcggacatatgtttcgctttcgctacgctacggccgaggaacacttcaccttcttcttccgcgtacagcagtggacccaatttctcagagaagccccactgagtcaccatgttacgtgccaggttggtcgcaactttaatatcgttggacgcaccggtagaaacatgttccggcccgtagatgatctcttctgccagacgaccaccgtacagcgtagaaatctggctttccagtttctgacggctggcgctgattgcgtcgccctcaggcaagaagaaagtcacacccagcgcacgaccgcgtgggataatcgtcactttgtgcaccggatcgtgttccggcaccaggcgaccgataatcgcatggcctgcttcgtggtaagccgtcgattctttctgcgcttccgtcatcaccatggagcgacgttccgctcccatcatgattttgtctttcgctttctcgaactcaaccatcgacacaacgcgtttattgccacgagctgcgaacagtgccgcttcgttcaccaggttcgccaggtcagcaccggagaaaccaggagtaccacgggcaatgattgccgcgtcgatatcgggtgccaatggtacgcgacgcatgtgaactttcaggatctgctcacgaccacgaacatctggcaagccaaccacaacctgacggtcgaaacggccaggacgcagcagggccgggtcaagaacgtccggacggttagtcgcggcgataacgatgataccttcgttaccttcgaagccatccatctcaaccagcatctggttcaaagtctgttcacgttcatcgtgaccaccgcccagacctgcgccacgctggcggcctacggcgtcgatttcatcgataaagatgatgcacggtgccgctttcttcgcctgttcgaacatatcacgaacacgggatgcacccacaccgacgaacatttctacgaagtcagaaccggagatagtaaagaacggaacttttgcttcgcctgcaatcgctttcgccagcagcgttttaccggtacccggaggaccgaccatcaggacgcctttcgggatcttaccgccgagtttctggaagcggctcggctcgcgcagatactcaaccagttcagcaacttcttcttttgcttcgtcgcagcccgcaacgtcagcaaaggtcgttttgatctgatcttccgtcagcatgcgcgctttgctcttaccaaacgacatggcacctttgccaccgccgccctgcatttgacgcatgaagaagatccagacaccaatcagcaacagcatcgggaaccaggagatgaagatagaagccagcaggcttggttcttcaggcggttcaccgacaaccttgacgttcttggtcaacannnnncattccattcattaattaattaatgaatgaatgnnnnntgaccagccagagtattaggtttttcgccatgtcactcaagggattaacctcttattacaactgtgttaaaaacagcgtcaggatactctatatccagcatctttcaaactttcgtctgaaatctcccggttagggtttacgcccggtcgctacaatatacacttcccgcgaacgtgcacgagaagagtccggcttacgaactttgaccttcgtaaacagggagcgaatttcccttagatactcatcgaaaccttcgccctggaacaccttcactacaaaactgccacctggcgctaatacatcacgacacatttctagcgccagttccaccagatacatggcacgggggatatccaccgccggtgttccgctcatgtttggtgccatatcggacatgacaacctggactttgctgtcgccaacgcgctccagcagtgctttcatcaccagttcatcacgaaaatcgccctgaagaaagtccacaccaacgataggatccataggtaaaagatcgcaagcgatgatgcggcctttgccgccaatttgggtgaccacatattgtgaccaaccacccggagcagcaccaaggtcgacaaccgtcattcccggtttaaagagtttgtcactttgctgtatttcatcaagtttaaaccaggcacgggaacgtaacccctttttctgtgcctgttgaacatatttatcgctaaagtgttcctgaagccagcggctggagctggcagaacgcttcttacctgtcatttaactttcccatggggataactcatcgtaaccaattgcgtaaatttttacgcgcctatttggtgatatatgggagatggcggtagaatgacccgttttcaatcccaacgtaagcaaaaaatacgatgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaagattatcctaaagttacacacattcgctgtgtaaaacgaggggttttccgcaggcaggagagcaaaatgccacgctctgttcgttgataaaaggccgcatagcggcctttttcctttctttacaatacatcaacatcttgagtattgggtaattcttacaggtattccaccttaattacttcaaattctacttcgccgcccggcgttttgatgaccacaacatcatcttcttctttgccgatcaggccacgagcaataggcgagtttacagaaatcaggttttgtttaaagtcagcttcgtcatcgccaacgatgcgataagtctgttcttcgtcagaatcgagattcagcaccgttacggtagcaccaaaaataacgcgcccattgttgggcattttggtgacatcaatcacctgcgcgttcgacagcttggcttcgatgtctttgatacggccttcgcaaaagccctgctgttcacgagctgcgtggtattcggcgttttctttcaggtcgccatgctcacgcgcttccgcgatagcagcaatgatttcaggacggcgcacagatttcagaaaatccagctcttcgcgtaatttttcagcgccgcgtaaggtcatcggaatagcttgcatttgttatacctcttgaatattcctgatggggcaagtcttcacccaccccggctgttcggcctgcccggcataactcctcaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtacattactcaactccccgctggtgccaaccttgccctgatggtgcaaaaagtcggcgcgtcggcccccgctattgattaccacagtcagcagatggcgctgcccgccagtacgcagaaagtgattactgcactggcggcgttgattcaactcggccccgattttcgttttaccacgacgcttgaaaccaaaggcaatgtggaaaacggcgtacttaagggtgacttagtggcgcgatttggtgccgatccgacgttaagacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccatctcgctctacagtgccccaaaacctggtgatatggcttttatacgcgtggcatcttattaccccgttacgatgttcagccaggtacgcaccctcccccgtggttctgccgaagcgcaatattgcgagctggatgtggtgccaggcgacctgaaccgctttacgctgaccggatgcctgccacaacgttctgagccgctcccgttggcttttgccgtgcaggatggagccagctatgccggtgcaattctgaaagatgagttaaaacaggcaggtatcacctggagcggaacactgctgcgtcagacgcaggttaacgaacccggaacggtagttgccagtaaacagtcggccccgctgcacgatctgcttaagattatgctgaaaaagtcggacaacatgattgccgatacggttttccgcatgatcggccatgcgcgcttcaatgtgcctggaacatggcgggcaggatcggacgccgtgcgtcagatcctgcgccagcaagccggtgtcgatatcggaaacaccattattgccgatggttcagggctttcgcggcataacctgattgcccccgccaccatgatgcaggtgctgcaatatattgcccaacacgacaatgaacttaactttatctccatgctgccgctggcgggctatgacggctctttgcagtaccgtgcaggtctgcatcaggcgggcgtggatggaaaagtctcagcgaaaaccggttcgttgcagggggtatataacctggcgggattcattaccacagtgagcgggcaacgaatggcgtttgtgcaatatctttctggctatgcagtagaaccggcggatcagcgtaatcgccgtattccgttagtgcgttttgaaagccgtttgtataaagatatttatcagaataattagcctaaagagaaaccccggcacatggccggggttttgctgattaacgcttgtaaatgaactcaacgccttcttcgtcgtcttcgtcccagtcgtcatcccagtcctcatcatcctcttcagcaatctcttcaagctgctgacggtgataatcatcccacatgaattcgactttctctggctgtttcgcttcttcagcctgcacgaccgggttttcaatgataaaggtcatcacatcccagcagagatctttcacgcccagtccgctcgccgcagagatcagataatatttatcttcccagcccagcgcttcagcgatcgctttcgctttctcttcggcttctaccttatccagcagatcgatcttgttgaagactaaccaacgcggtttcgccgccagatcttggctgtatttttccagctcactgataataatacgcgcgttttcaaccggatcggtgccgtcaatcggatcgatatcgatgaggtgcaacaggacgcggcaacgttccaggtgcttcaggaagcgaatgcccagacstgcgccttctgcagcgcytcaatcagtcctggaatatcggcaacaacgaagctcttttcgttgtccatacgcaccacgcccaggcttggtaccagagtggtaaacggataatccgccactttcggtttagccgccgataccgcacgaataaaggtcgatttacccgcgtttggcatccccaacataccgacgtcagccagcagcatcagctccagcagcagctcacgcttatcgcccggcgtaccgttagttttctgccgtggtgtacggttaactgacgacttgaaacgggtattgcccagaccgtgccagccgcccttagcaaccagcagacgctgaccgtgtttggtcatatcgcccatggtttcaccggtaccctggtcgattacacgcgtacctaccggtactttaatcgtgacgtctttaccgcgcttaccggtacagtctcggcttgcaccgttctgaccgcgctctgcacggaaagatttttcaaaacgataatcgataagcgtgttcaggttctcgtcggcttccatccatacgtcaccaccatcaccgccgtcgccgccatccgggccgcctttcggaatatacttttcgcggcggaagctcacgcaaccattaccgccatcacctgcaacgaccagaatcgatgcctcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaatgtattcagtccgcaaaaaattaaacatgcgagctgccagtggctaagctgcgctatcactccaggatttgccagagggaagagcgcaattgtacataaagtgtacagtaaaaacaggatctgcggtgaggccagccgacgcaataaaaccttttgcgccacgccataactcacccaaaccgtcgccgcaccgaccccaaagataactccccaggtgtaatcggtgagctttgtaaatatctcgaccagactggtgttaaaaaacatcaccaggccnnnnncattccattcattaattaattaatgaatgaatgnnnnngtactgcgcattttctctttcaggataaatacgctggcaaccatcatgccaactggcgagagttgcccaattactgcgaagcggtcggactcaggtattgcaaggatgagctgaacaggatgaagttcccaaacagcccggcggtcgccactgctaacaaaatcaaccagcgtggcttacgaaacacgcgtaatggcggcaaccgcttcttcaccgcaagaatggcaccaaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatttgcggattaacatcgcaccatgcgcatttttaccggttatcgaatgtaaaaagccccgcaacgtgttgcggggctttcatccgttaccgggatgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaagcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaannnnncattccattcattaattaattaatgaatgaatgnnnnngtactgcgcattttctctttcaggataaatacgctggcaaccatcatgccaactggcgagagttgcccaattactgcgaagcggtcggactcaggtattgcaaggatgagctgaacaggatgaagttcccaaacagcccggcggtcgccactgctaacaaaatcaaccagcgtggcttacgaaacacgcgtaatggcggcaaccgcttcttcaccgcaagaatggcaccaaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatttgcggattaacatcgcaccatgcgcatttttaccggttatcgaatgtaaaaagccccgcaacgtgttgcggggctttcatccgttaccgggatgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaagcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaannnnncattccattcattaattaattaatgaatgaatgnnnnncgtttgcgatcatcagcacttcagcgaactcaacagtttcgccagttgcgatgtccagcttttccaggcgaacggtctgaccttcgcttactcggtgttgtttaccaccactttggaaaaccgcgtacatataaaactccgcttccgcgcacaccttttcaatgattcagagtgcgctataaatattcacaatagggcgcgaatattacgcaaaacgcacgcctttgacaagtgctacagtcaatacacgaagaaaaaaaacacaacttgtacggtaacgtttatctgtgccattttttcagtacaatcaccctatattcctaaccataaaccctaagttgcctttgttcacagtaaggtaatcggggcgaaaagcccggcttttgcgatgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccctgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgcgttccagatgatgaccagcctcggttcactcaaagtgctggaagtcatgtcagaagccgtaaacgtcatcgcagaaggtgaagttctgcaactgatgaacgttaacgatccggacatcactgaagaaaactacatgcgcgttatctacagcaagactgcgcgtctgtttgaggctgccgcgcagtgttccgggattctagctggctgtacgccggaggaggagaaaggcctacaagattatgggcgctatctcggcactgctttccagttgatcgacgatttactcgattacaatgccgatggcgaacagttaggtaaaaacgtcggcgacgatctgaacgaaggtaaaccgacgctgccgctgctgcatgcgatgcatcatggcacaccagaacaggcacagatgattcgtaccgccatcgaacagggtaacggtcgccatcttctggaaccggttctggaagcaatgaacgcttgtggatctcttgaatggacgcgtcagcgtgccgaggaagaagcagacaaagccatcgcagcgttacaggtgctcccggacaccccgtggagagaagcactcgtcggcctcgcgcacatcgctgttcaacgcgatcgttaatcccctcccctcatcccgcgcagtgcgcgggatgattccagtaaattccataaaacacttattcagctctataactcctgaaaaacggggctgtgtatctttatatattctgaatattcacactctttacaggaactttttagagcaataggccatcaggagtatagtgatgctcgacagaaacagaagaagtgttctgaatgaaagcgactaacttaaggagtgaggaaagatggaaagtaatttcattgactggcatcccgctgacatcattgcaggtttgcgcaagaaggaaacgtcaatggcggcggagtctcgcagaaatggtttgagttcctcaacgctggcgaacgcattatcacgcccatggccgaaaggagagatgattattgcgaaagccctgggaactgacccctgggttatctggccatcacgctaccatgatccgcagacccatgagtttatcgacagaacgcaattgatgcgtagctacactaaaccgaaaaaatgagtggtctggcggtagccccgcgaacggggctgccagctctcagacaattactcgcctttcacacgctcaatatttgcacctaaagcgcgtagtttgtcttcaatgcgttcgtagccacgatcgatgtgataaatacgatcaaccaccgtcgtcccttccgcaatacagccagccagcaccaggcttgctgatgcacgcagatcggttgccataacctgtgcgccagaaagtttttcaacaccgtgacaaataacggtattgctttcgatttcggcgtgcgcgcccatacggctcagctctggcacatgcataaagcggttttcaaagaccgtttcggtgatgaatccggtcccttctgccaccaggttcaacagcgtgaactgggcctgcatatcggtagggaatgccggatgcggcgcggtacgtacgttaacagccttcggacgtttgccatgcatatccaggctaatccagtcttcgccgacttcgatgtccgctccagcgtcacgcagtttcgccagcacggcgtccagagtatctggctgcgcgttacggcagataattttgccgcgagagatcgccgccgccaccaggaaagtaccggtttcgatacgatccggcagcacgcgatagacaccgccgcctaaacgttccacaccttcgatgacgatacgatcggtgccctgaccgctaattttcgcacccagcgtaatcaggaagttcgcggtatcgacgatttccggttcacgcgctgcgttttcaataatcgtggtgccttccgcaagggttgcagcacacatgatggtcaccgttgcgccaacgctgactttatccatcacgatatgtgcgcctttcaaacgaccatcgacggaagctttaacgtaaccttcttccagtttgatggtcgcgcctaattgttcgaggccagaaatgtgtagatcaaccggacgtgcgccgatcgtacaaccgccaggcagtgaaacttgcccctgaccaaagcgcgctaccagcggccccagcgcccagatagaagcacgcatggttttaaccagatcgtaaggtgcgcagaatacattaacgtcgcgggcatcaatatgcacagaaccattacgttctactttcgcacccagctggcttagcagcttcattgatgtatcgacgtcttttagtttcgggacgttctggatctctaccggttcttccgccagtagtgcggcaaaaaggataggcagagcagcatttttagcgccggaaattgtgacttcgccctggagcttcgttggcccctgaacacgaaatttatccatttagtttgttctcagttaacaattcatatccgctaccggcgaatcgcccatagctcaaaagccgttcagtttgcgatcgcgcgcccactccgcaggggtatacgctttgatcgacacagcatgaatgcggttatccgcaatatattccatcagcgggccatagaccgtctgctgttttttaacccgactcatgccgtcaaacaactcacccacggcaataacctgaaagtggctgccatcgccggaaacgtggacttcctggagggagagagcgttcatcaacacgctctgaatttcattattttccatgggatcttcaatcatcagttaataaatcagcgaaacatcttagagcaaagttgcgctggcataaataagcaaaaagcctcgctgataaatcagacaaggctcgacttgcaggcaggtttgccggacaggcggttaacgccatatccggcctgaaaaaatttaacgaggcagaacatcagcaggcaaattatacaatttcgccagggtatacactttgtcgtttaccccctgaagcgtcacattgttgccctgctttttcgccagatcgataagatggagcagcagtgccagtccacccgtatccacgcgagacacacggctaagatcgatgctggtaatccccttcaccgcttcctcacgtatttcccaaagcggtagcagaacgtcctgatccagctctccggataacgccagcgtgtcacccgtctgcatccagctcagtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccagttgcccgtctgggagtttttacgccactggaagtccagacgcaccggcgggcggccattcgggtcaataatggtaacgcgaatcggcacaatgattttatcacccagcggctgttctggtgcaatctgataggtttgaccgtgatacatcgccagcgcctgaccgtaagcctgcttcaggtactcacggaaagcggcaaagtaagcatcacgttgagctggggtcgcactcttgtaatactggcccagcaccagcgcaccggcgtatttcacctgtacgtatggcaacagttcctgatcaacaatggtacgcagataatccgggttggcccgaatttgcggttgctcattcttcaggcgatcgaacgttttctgcgccgcctcgtccatcagcttatacggattggtctggtctgccgcggttgccgcactcagcggtgcaatcaccagcaaagcgaccatcattaaacgtttaaacatgcgtcggttctcctgaaattatttcgttgtacccacaggttcagtggtttcattattacctggcgcagcagctggcgcatcgccactattcttattgtcatcgcctttactaccgtaaaggaactgaccaatgagatcttccagcaccatcgcagacttggtgtcctgaattgtatcgccatccttcaggatagcagttcccagttccgggtcttcaaaaccgacgtttaatgccagatattgttcccccagcaagccggaagtacgaatgctcagcgaactggtatcaggaatgtggttataacgttgttcaatttccagcgttacgcgcggcagataggttttcgggtccagcgtaatatccgccacccggcccacaacaacgccaccaatgctgaccggagagcgggctttcaggccgccaatgttatcgaacgtcgcataaagcgtataggtcggttcagtacgtatagacgtcacgttcgctgccttcaggcaaacaaacagcgccgcaagcagtgctgctaataaaaagatacccacccaaatttcattttttttcgtttgcatgaactcaattcccaaacatcaatgcggtcagcacaaaatccagccccagaacagccagagacgagtggacaacggtgcgagtggttgcccggctaatcccggcagacgtcgggatggcgtcgtagccgttaaacaacgaaatccacgtcaccgtgatggcgaacaccacgctcttaatcagacagttgacgagatccatacgccagtcgacggcattttgcattgccgaccagaagaacccactatcaatgcctttccaactgacgccgaccagcgatccgccccagatccccacggcgacgaagataaccgtcaacagtggtaatgaaataactccagcccagaaacggggagaaataacccgacgcagcggatccaccgccatcatctccatactggagagttgctctgtagcgcgcatcaggccgatttctgcggttagcgccgaaccagcacgcccggcaaacaacaacgcggcaaccaccggccccagttcacgcagtagcgataacgccaccagcatacccagactggtttccgcactataagtggtcagaaccagataaccttgcagccccaacaccattccgatgaacacgccagaaaccacaataatcagcatcgacaggacgccgacattatagagctggcgcaccagcagcggtgcatgtttgcgaaattccggtttgccgaccagcgcattgaataacattaacccggcccgcccgaacgttctcagggttttaatccctttatgtccgagcgacgccagcgcatttaacagcatgagtggcttaactccctggtaaaagatcagcgtgataatcgccggcaggatagcggaacggaacaggcccgtcagctatcccgtccagaaactgacgtacgcgcggatcaggattcgcctgcaacgcctgggcactgccatgagcgacaatttttttgtccgccaggatccaggcgtgatccgcaatacttaacacttccggcacatcgtgagaaaccaccacacaagtcacgcccagcgcgctgttcagctcagaaatcagcttcaccagcacgcccatggtaatgggatcttgcccaacaaagggctcatcaaacatgatgagatccggctccagcgcaatcgcacgtgccagcgctgcacgccgcgccatcccaccggaaagttcagaaggcataagtttagccgctccacgcagccccacggcctccagcttcatcatcaccgtactatgcaacaatggcgcgggaagttgggtatgttcccgcagtggataggcgacgttgtcaaatacgttcatatcagtgaacaacgccccggactgaaataacatgctcatccgtttgcgcactgtatacaggcgcgaacgagacatcgccggaatattctcaccatcgaaaagaatctcaccatgatctggtgcgatttgcccgccaatcagacggagtagcgtcgttttaccgatgcccgatggccccatgatcgccgtgatcttccctcgcggcacggtcagggaaatattatcgaagatgcagcgattgccacgcgtaaaactgacatcgcgcatatcgactaaattcgccacagactgctccataattcacccttcgtcttgcgttgattttctaagcatggcgctcaatttaaccttgaacccaacatatttacagaatattacctgccgtggttagcgaaagctggcatttgttttactttttagccgcataaagtcaaaattaagaatctgttacggctttctgaaaatcttcagcggaccggcgagtatacctgaagaaaggacgttagatgcttttagctacggcactgttaattgttggtttacttttggtcgtttacagtgccgaccgcctggtttttgccgcgtctattctttgccgaacctttggcatcccgccgttgatcatcggcatgacggtggtcagtattggtacatcgttaccagaaatcatcgtctcgcttgccgcgtctttgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgaaggtggattgcccgtcgcatttttatggctcggcatcgcactgatcattatgccagtggccacgcggatggtagttgataacgccacggtgctggcgaattactttgccattagcgagttgacgatgggttctgacggcaattgctatcggaaccagcctgccggaactggcaaccgcaatagcgggggttcgcaaaggtgaaaacgacattgcggtcggaaatatcattggtgcaaacatttttaatattgtcatcgtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatggggatggggaaatcggggcacatcgggcgcaaaatggcagcaacatttgccagcaccggtacaccttcatttttcgtccatcctggcgaagccgcgcatggtgatttaggcatggtcaccccacaggatgtggtgattgctatctctaactcaggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtagcgaaagaagcctgtccgttagggctggcaccgaccagcagcacaaccgccacgttggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcattgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgcgtgcgcccaggcattctggccgttgaggcactgaacttaatgcagtcccgccatatcacctccgtgatggttgccgatggcgaccatttactcggtgtgttacatatgcatgatttactgcgtgcaggcgtagtgtaaagattcaaggataaacaacaatgagcaaagcaggtgcgtcgcttgcgacctgttacggccctgtcagcgccgacgttatggcaaaagcagagaacattcgtctgctgatcctcgacgttgatggcgtactgtcagatggcctgatttatatgggcaataacggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtgacgcgcattgctggcggtcgtggcgcagtgcgagaagtttgcgacttattactcctggcgcagggcaaactggatgaagccaaagggcaatcgatatgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatgggcacgttgaagtcaatgcactcgtgccggactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggcaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcacagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaaccaccgttctggtgccgtcgcagctgcaggacaaaaacaataaaggccagaccccggcacagaagaagggtaattaattcgttatggcaacattaactgcaaagaaccttgcaaaagcctataaaggccgtcgcgtggtagaagacgtcagcctgaccgtcaactccggggaaattgtcggtctgctggggccaaacggtgccggtaagaccaccactttctacatggttgttggcattgtgccgcgcgatgcgggcaacatcattattgatgatgacgatatcagtctgctgcctctgcatgcacgcgcgcgccgcggtatcggctatctgccgcaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctgatagggtagaagtttgcgacgttttagcaggagagtacgattctgaacatgaagcaaggtttgcaactcaggcttagccaacaactggcgatgacgccacagctccaacaggcaattcgtctgttgcagttgtcgacgctggaacttcagcaggagctacagcaggcgctggagagcaatccgctgcttgagcaaatcgacactcatgaagaaatcgacacccgcgaaacgcaagacagtgaaacactggacaccgccgacgcgctcgaacaaaaagagatgccggaagagctgccgctcgatgccagttgggacaccatttacaccgctggtacaccatccggcaccagcggtgactacattgacgacgagctgccggtctatcagggcgaaacgacacagaccttacaggattacctgatgtggcaggtcgagttgacaccattttccgacactgaccgcgcgattgctacctctatcgtcgatgccgttgatgacaccggttatctgactgtcccgctggaagatattctcgaaagtatgggcgatgaagagattgacatcgacgaagttgaagccgtccttaagcggatccaacggtttgatccggtcggtgtggcggcaaaagatctgcgtgactgcctgctgatccaactctcccaattcgataagaccacgccatggctggaagaggccagactgatcattagcgatcatctcgatctattagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacggtagaactcaacagtgacagcattccgcgtttgcaaatcaaccagcactacgcctcgatgtgcaataacgcgcgcaacgatggtgatagccagtttatccgcagcaatctgcaggatgccaaatggttgatcaagagtctggaaagccgtaacgatacgctactgcgcgtgagtcgctgtatcgttgaacagcagcaagccttctttgagcaaggcgaagaatatatgaaaccgatggtactggctgatatcgcccaggccgtcgagatgcatgaatcgacgatatctcgcgtgaccacgcaaaaatacctgcatagtccacgaggcatttttgaactgaagtatttcttttccagtcacgtcaatactgaaggcgggggtgaagcctcttccacagcgattcgcgcactggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacagctcgtttgacccaaccgataaggaagacactatgcagctcaacattaccggaaataacgtcgagatcaccgaggcactgcgcgaatttgttacagccaaatttgccaaacttgagcaatattttgaccgaatcaaccaggtctatgttgttctgaaagtggagaaggtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaattgtccgggcaattagcatgtgcatggcggcctgttgtgcggcacaacgggccatttgtacggttaatgctccgagcctgttccactgtttgagtgggcaggttcttaggtgaaattatgacaaataatgatacaactctacagcttagcagtgttcttaacagggaatgtacgcgaagccgcgtccactgtcagagcaaaaaacgcgccctggaaatcatcagcgagctggcggcgaaacaacttagcctggcgccccaggtggtttttgaagctatcctgacgcgggaaaaaatgggcagtaccggtatcggcaatggtattgccattccgcatggcaaactggaagaagatactctgcgtgccgttggcgttttcgttcagctcgaaacgcctatagctttcgatgccatcgacaaccaaccggtagacttactttttgccctgctggtgccggcagaccaaactaaaacgcacctgcatactctgtcgctggtagcgaaacgtctggcggacaaaaccatctgccgccgtttacgcgcagcccagagcgatgaagagctgtatcaaatcattacggataccgaaggtactccggatgaagcgtagttattcggtaatgtctcttttagacgttgtgaggagaaacagtacatggtactgatgatcgtcagcggacgttcaggttcaggtaaatctgtcgccctgcgtgcgctggaagatatgggtttttactgcgtggataaccttcccgtagtgttgttacccgatctggctcgaactctggccgatcgagagatttctgccgccgtcagcattgatgttcgtaatatgccggagtcaccagaaatattcgaacaggcgatgagtaacctgcctgacgctttctcaccgcaactactgttcctggatgccgaccgtaataccttaattcgtcgttacagtgacacgcgccgactgcatccgctttccagcaaaaacctgtcgctggaaagtgctatcgacaaagaaagcgatttgctggagcctctgcgttcgcgagcggatctgattgtcgatacctcagaaatgtccgttcacgagctggcagaaatgctgcgtacccgtctgctgggtaaacgtgaacgtgaactgaccatggtctttgagtctttcggcttcaaacacggtatccctatcgatgcagattacgtctttgacgtgcgcttcttgccgaacccgcactgggatccgaaactgcgcccaatgacaggtcttgataaacctgtcgccgcgttcctcgaccgccacacagaagtacacaattttatctaccagacgcgaagctatcttgagctatggttacctatgctggaaaccaacaaccgtagctacctgacggtcgccattggttgtaccggcgggaagcaccgttcggtgtatattgcagagcaactggcagactacttccgctcgcgcggtaaaaacgtccagtcacgccatcggacgctggaaaaacgtaaaccatgaccgtcaagcaaactgttgaaatcacaaacaagctgggcatgcatgcccggcctgcaatgaagctgtttgaattaatgcagggttttgacgctgaagtgctgttacgtaatgacgaaggcaccgaggctgaagccaacagcgttattgcgctgctgatgttggattctgccaaaggacggcagattgaagttgaagcgaccggtccacaggaagaggaagcactggccgccgttatcgccctctttaactctggttttgatgaagattaatcttcatcactttgacattcaaatcccttcaagctcccccggcaataagaaaagcgcgtactgaaatcgttatcaatcaacgtcgattgtacatttcgtgcgcttttttactttcagaagaaccttaagaaaaccttaagaagcattgtttagatttcgtttaagttaatcgaccatactggagatcgtcagaaaatatttccaggagatggcatgattcgcttatctgaacaaagtcccctgggcaccggaagacatcggaaatgttatgcgcatccggaagatgcccaacgctgtatcaagattgtctaccatcgtggcgatggtggcgataaagagatccgccgtgagttaaagtactacgcgcatcttggtcgccggttaaaagactggagtggaataccgcgctatcacggtaccgttgagacggattgcggaaccggttatgtctacgatgtgattgccgatttcgacggcaagccttccattacgctgaccgaatttgcagaacaatgccgttacgaagaagacattgcacaactgcgccagttactgaaacagctgaagcgttatttgcaggataaccgtatcgtgacgatgtcgctgaagccgcagaatatcctctgtcaccgcatcagtgagtcagaggttacccccgtcgtctgcgacaacattggtgaaagcacattgattccactggcgacctggtcgaagtggtgttgtctgcgtaagcaagagcggttatggaaacgatttatcgcccaaccggcgctggctattgccctgcagaaagatctgcaacctcgtgagagcaaaacgctggccctcacttcgcgcgaagcttaatcaagctggtgttgttgcataaacggctcaccgcctaactgatacatctgccgtaaaatccacgcctgacggctacgcacgtagcccgatggcgcggagactttgaaacgaagtggattaggtaatacagctgccagcaatgcagcttccgaccgggtaagtttgctcgcgggtttgtggaaataacgttgtgccgcagcttcgacgccaaacacaccgtcgccaaattcggcgatattcaggtaaaccgtcaggatacgctttttgctccagactgtttctatccccagcgttaatccggcttccagcccttttcgaacccagctacgcccatcccataaaaagagatttttggctgtctgctgagaaatcgttgaagcaccgcgaatacggttttcattgcgctcgttgtgcgccagggcttgctcaatggaagcgacatcaaagccccagtgctcaggaaatttctgatcttctgcggcaatcaccgccagtcccatccacggcgagatttgatccatactgacccagtcagaatgtgccacgtaacgaaaattgccatgcagccaggcgctgacttgccgctcgaccattaccgctgagaaaggaacaggcgcaacgctaaacaacgcgatgcccccgccccagaaaatggcgaggacaaccattaaccgcagaagaaaacggcgaacgaaactaaacaccgttaagcggcttttactcattcagccagaaccagcacgcgggaaaccagcttatcaatgccgctcgccgcttctgcaatgttctgcgccagcatatatgccggggtggtgacaatcttattgtcttcatcaaccacgatatcatcgacaggacacggcacatgctccgcgcccatctcttccagcacttctgcggtatcgatatcagtaccgatggtcaaacgcagcgggaaatcgaaaattttcggcagtatcgccggtgctatacacataaaaccaagcggttttccggcctgatgcatcgcttgtgccagcgcctttaattcacggtcaacggtgcattcgctaccaagactggcaaaattgcttaaattcttcaccgcgccaaaaccccccggcacaatcaacgcatccagttcagcggcatcggcctgggccagaggacggatttcaccgcgcgttattcgtgccgcttcaatcagcacattgcgcgtttccgtcatcgcttcaccagttaaatggttgataacatcaacctgctgcttatccggtgcaaagcagaccgcctgcgcaccgctgcgtgaaatagctaacaacgtcaacaccgcttcatgaatttcagaaccgtcatagacgccgcatccgctcagaattacgccaattttcttcattgtgatcttcctttcgcaattgactgaaacacattaatttttttaataaaaatgctacgcatcacacatttaactgattcatgtaacaaatcatttaagttttgctatcttaactgcgtgcggcctgaaaaacagtgctgtgcccttgtaactcatcataataatttacggcgcagccaagatttccctggtgttggcgcagtattcgcgcaccccggtctagccggggtcattttttagtggcttttgccacccacgctttcagtacttctacgtcgtgacgccactcttctttcatctcttcaatccattcaccgacgttatcttcccaggcgggaaggtcaggagactgaatttgctgacccagctgttgcagatggcgtaaccccactgaccccgccgcacctttaattttatgcccttcctcaacaatgccttttttatcctgcgccgtcagattcgactccagcacgctgacatagcccggcatcatcctctcaaacaccgctaacccgtcggtgatcagcttcggtcctacaagttcgagatactgttccagcatgggaatatcgagcaatgcttctgatttactgttctcttctgtcgtcaccgtactctcctcatcatcctgggtatcccagaatttcttgatcatcgcggttagcgccggaacagaaagcggcttactcagcacatcatccattccagcattgaggtactcttgtttgtctttcagcacgttagcggttaaggccaccagcggcggtaaatcctcgcgcggataacgcttcgtcagttcacgagagatatccagcccggtcatatctggcaactgaatatccagcaacaccaggtcgtattcgcccggtttaaacatctccagcgccgccttgccggtcatggcgacatcaacgctgttacctaacttttccagcacagagcgcgcgacaatcacgttcagttcaatgtcttccaccagcagcacattcagcgccggtaaaggcatatcgtcttcatcaaacgcatcatcaacctcttctgctaccgacggtgcgtggatcgtcaacgtaaaggttgaacctttgccctgttcgctggtaaccgtaatatcgccgcccatatttttcgccagacgacgagaaacggccagaccaataccggtgccggtggcaggtttaccgccatgactgtctttcacctggtaatacatggcgaagattttatccagctcatcctgcggaatgccgataccagagtcttccacttcaaaatgcagcatatcgccttcatcgtagcgcacgcgcacggtaacctggccttgctgagtgaatttgacggcgttactgatgaggttccacaagatctgccgtaaacgcgtcccgtcggtaatgacctgatgcggtaatggcagcgtcggctccagattaaagcgcaatcctttttgttgcgcctgcaatgcggagagattttccagatcggcaaggaagctggtgaaatcaaccggctgattatcaagctggaccttgcgccgttccatcttatccatgtcgataatatcgttgaagatattccccaacgtgacagccgaaacatggatggttttgagatatttttcctgctcggcggtgagttcagtatccagcagaatgcggctcaggccgacgataccgttcagcggtgtacgcaattcgtgactgatggtggagataaacgtcgttttgtcgcggctggcgcgctcaagcgcatcctgataccgcttacgctcggtaatgtcgcgaccaaagcccatcaaaccgtgacgtttacccacgcggtcgtagtacggtactttacggatttcaaagcaggctttgcgtccgtcgggataatccagccactgctcataggtcagtgacacattatgacggaacactttttcatcggtttcaatgactttcgcagcggcttccggtgagtaaacatcagcaggtttcaggtgaaccagttgtttttcgctttttccggtcagcagctccatcgcgcggttacagccggaaaactctttatcttcgttacgataaaaaaccaggtcgggtgaagcgtcaaggaaggaacgtaagaatgaggattgctgctcgagctgaatttgtgtctcttcgcgctctttgatttcaattttcagttggccgaaggtttcctgcagttctgcttccgctttttcacgaacggcgatttcctgatttagctgggcaatattatcttttaactgaacgttgaggctcaaatcgcgctcgcgcatctcctccagtttttgcaccagtcgtgacagacgttgtcgtgactcctccagttgctcgacgaccaccgatagaaagtagaccgcccacggcgtaatcagcaaaccaaagaagatagaacgaataacatcaatgctttcgacctgaccatgcagcaccatggttaccgccatttgtaccacaatggcaagaacgacgagggccagcgccagcaacattgagaagcgcaccagacctaacttcatcatcaggtcaacataatactgcgccagcagacgaatttgcttcattagggaattccttcacgacaacctgccccaataatacccaattctgacagttacgttataaattgtgtgagaaatgcggaattcccctcaatggcctacgccgttggaggtagccacggacgtcccagcgccgatccctgtacgccatgttcattcagataacgatccagctcgaccattcccgtccatcgattttcgcaccacaacggagcaagcagcgtcgggcgacgggcgctggcggaaatgcggtggtagatcacttccggtggcgtatggcgaatcatttctccggcagtgagcgtgtaatcctccagttcaattccgttcaaacgccccgcttcccaggctttcgccataatgctgcctttcactatatgcagcggatgcagctttatgccgtccacgccggtttcaaccactcgctccagcgtttgcaaacattcagcctgcccttcgccaggcaggccaacaattaagtgagaacacaccttcagcccacgctcacgcgccagctgcgtcgtgcgctgatagcaggcaaaatcatgaccgcgattgatgcgatgcagtgttttgtcgtgggcggtttgtagccccagctccagccacacttcgtagccctggtccttatattcgcaaagcagatccagcaccgcatccggcacgcagtccgggcgggtaccaacacacaaaccgacaatattggcctggctcaccgcctgctgatacatcgaacgcagcacctgaacttccgcaaaggtgctggtatacgcctgaaagtaggccagatagcgtttagcgcggttaactaaattcgcctggtgcgccagttgctcggcaatggaacgatgctgctgcgcttcatcggcaaacgaggcaacattacagaatgtgcagccgccacgcccgatggtaccgtcacggttagggcagctaaaaccgccatgcagcgtcagcttatgcaccttttgcccataacgacgggtgagatcaccaccaaacatattgactaatttctgtaactgcataatctgatagaccgcgccttgaaaagaggccaaagcctgccatttttagcccaattcggcgatgacctggatcaatcgtcccggcctgcttttatcaactgcataatcaatcaaaattaccgaaatttcatgcacaatcacataaatcacttttgcttatcttgtgtcagatttttttatctccttatggattttaggcaaaaacagtagcatgaaacgttattaccaattaaggcagtataaaatgctggttttctcgtcagttcaaggcaggataagggttaacacgcctttatgacagtcaggtattggctgtttctctaacgacgccccttttagccttaaatagaaaatccaatttaatttcagataattaataaagaattttgcgctaaagcacatttctgtaccaataagcttgccatttgacctgtatcagctttcccgataagttggaaatccgctggaagctttctggatgagcagcctgctcatcatatttatgcagtaattgagatcccctcttcaccgtattaaccgatgcgaaaaggacaacaagggggcgaatgcgaggcgcgcgtatgacacgcaaaccccgtcgccacgctcttactgtgcccgtgcgcagcggttcggaagtggggttcccgcagagcctgggggaggttcacgatatgttgtacgataaatcccttgagagggataactgtggtttcggcctgatcgcccacatagaaggcgaacctagccacaaggtagtgcgtactgcaatacacgcactggcccgcatgcagcaccgtggcgcgattctcgccgatggtaaaaccggtgacggttgcggcttgctgttacaaaaaccggatcgtttttttcgcatcgttgcgcaggagcgcggctggcgtttagcaaaaaactacgccgtcgggatgctcttcctgaataaagatcctgaactcgccgctgccgcacgccgcatcgttgaagaagagctgcaacgcgaaacgttgtcgattgtgggctggcgtgatgtccccactaacgaaggcgtgctgggtgaaatcgccctctcctctctgccacgcattgagcaaatttttgtgaacgccccggcaggctggcgtccgcgcgatatggagcgccgtctgtttatcgcccgccgccgcattgaaaagcgtctcgaagccgacaaagacttctacgtctgtagcctgtcgaatctggtcaatatttataaaggtctgtgtatgccggcggatctgccgcgcttctacctggacctcgctgacctgcgtctggaatcggccatctgcctgtttcaccagcgcttttccactaacaccgtaccgcgctggccgctggcgcagccgttccgctacctcgcgcataacggtgaaatcaacaccatcactggtaaccgccaatgggcgcgtgcgcgtacctataaattccagacgccgctgatccctgacctgcacgacgccgcgccgttcgtcaacgaaaccggctctgactccagttcgatggataacatgctggaactcctgctggcaggcgggatggatatcatccgtgccatgcgtctgttagtaccacccgcctggcagaacaacccggatatggacccggaactgcgtgccttctttgactttaactccatgcatatggagccgtgggatggtccggcagggatcgtgatgtccgatggccgtttcgccgcctgtaacctcgaccgtaacggtctgcgtccggcacgctacgtcatcaccaaagataaactgatcacctgcgcctctgaagtcggtatctgggattatcagcctgacgaagtggtcgaaaaaggccgcgtagggccaggcgaactgatggtgatcgacactcgcagtgggcgcattctacactcggcagaaaccgatgatgacctgaaaagccgccatccctataaagagtggatggagaaaaacgtccgccgtctggtaccgtttgaagatctgcccgatgaagaagtgggtagccgcgaactggacgacgacacgcttgccagctaccagaaacaatttaactacagcgcggaagagctggattcggtgatccgcgtactgggtgaaaacggtcaggaagcggtcggttcgatgggcgacgacaccccattcgccgtgctctccagccagccgcgcattatttacgactacttccgccagcagtttgctcaggtaaccaacccgccaatcgacccgctgcgcgaagcgcatgttatgtcgctcgccaccagtatcggtcgtgaaatgaacgtcttctgtgaagcagaaggccaggcgcaccgtttaagctttaaatcgccgattctgctctattccgatttcaaacagctcacgacgatgaaagaggatcactaccgcgcagatacgctggatatcacctttgacgtcactaaaaccacgctcgaagcgacggtgaaagagctgtgcgacaaagccgaaaaaatggtacgtagtggcaccgtgctgctggtgctctccgaccggaatatcgctaaagatcgcctgccggttccggctccgatggcggttggcgcgatccagacccgtcttgtcgagcaaagcctgcgttgcgatgccaacatcatcgtagaaaccgccagcgcccgtgatccgcaccacttcgccgtgttgctgggcttcggtgcgacggctatttatccgtaccttgcctatgaaacgctgggccgcctggtagacacccacgcgattgccaaagattatcgtaccgtgatgctcaactaccgtaacggcatcaacaaaggcttgtacaaaatcatgtccaaaatgggcatctccaccatcgcctcttaccgctgctcgaaactgtttgaagcggtcggtctgcacgatgatgtcgtaggcctgtgcttccagggcgcggttagccgcattggcggggcgagctttgaagacttccagcaggatctgctgaatctgtcgaaacgtgcctggctggcgcgcaagcccatcagccagggcggcctgctgaaatacgtgcacggcggcgaataccacgcctacaacccggacgtggtgcgcacactgcagcaggcggtacaaagcggcgagtatagcgactatcaggaatacgcgaagctggttaatgagcgtccggcaaccacgctacgcgatctgctggcaattacgccgggtgaaaacgcggtcaacattgctgatgttgaaccggcaagcgaactgtttaaacgcttcgataccgccgcgatgtctatcggcgcgttaagcccggaagcccacgaggcgctggcggaagcgatgaacagcatcggcggtaactcaaactccggcgaaggcggtgaagacccggcgcgctatggcactaacaaagtgtcgcgcatcaagcaggtggcgtccggtcgcttcggcgttactccggcgtatctggtcaatgccgacgtcattcagattaaagtcgcccagggcgcgaagccgggagaaggcggtcagttgccgggtgataaagtcactccttacattgccaaactgcgctattcggtgccgggcgtgacgctgatctccccgccgccgcaccatgatatctactctatcgaggacttagcgcagctcattttcgacctcaagcaggttaacccgaaagcgatgatctccgtgaagctggtgtccgaaccgggcgtcggcaccatcgcgaccggcgtggcgaaagcttatgcggacttgatcaccatcgcaggctatgacggcggcaccggcgcaagtccgctttcatcggtgaaatacgcaggctgtccgtgggaactcggcctggtggaaacccaacaggcgctggttgccaacggtttacgtcataaaattcgtttgcaggttgatggcggcctgaaaacgggcgttgatatcatcaaagcggcgattctcggcgcagaaagcttcggcttcggcactggcccaatggtcgcgctcggttgtaaatatctgcgaatttgccacctgaacaactgcgctacgggtgtagcaactcaggatgacaaactgcgtaagaatcactatcacggcctgccgttcaaagtgacgaattactttgagtttatcgcccgtgaaacccgcgagctgatggcacagctgggcgtaacacgtctggtggatctgattggtcgcaccgacctgctgaaagagctggacggtttcaccgccaaacagcagaaactggcgctgtcgaagctgctggagactgccgagccgcatccaggtaaggcgctctactgcaccgaaaacaacccgccgtttgataacggcctgctgaacgcgcagttgctgcaacaggcgaaaccgtttgttgatgaacgccagagcaaaaccttctggttcgatatccgcaacaccgaccgttctgtcggcgcatcgctttcaggctatatcgcccagacgcacggcgatcaggggctggcagccgatccgatcaaggcgtacttcaacggcaccgcaggccagagcttcggtgtgtggaacgcaggcggcgtggaactgtatctgaccggcgatgctaacgactatgtcggtaaaggcatggcgggcggcttaattgccattcgtcctccggttggctcagccttccgcagccatgaagcaagcattatcggcaacacctgcctgtatggcgcgaccggaggtcgtctgtatgccgcaggccgcgcgggtgaacgtttcggcgtgcgtaactccggtgctatcaccgtggtagaaggcattggcgacaacggctgtgaatatatgacgggcggtattgtctgtattctgggtaaaaccggcgttaacttcggcgcgggcatgaccggtggcttcgcttacgttctcgatgaaagcggcgatttccgcaaacgcgttaacccggaactggtcgaggtcttaagcgttgacgatttggcgatccatgaagagcatctgcgtggtcttatcaccgagcatgtgcagcataccggttcccagcgtggtgaagagattctggcgaactggtcaaccttcgccacgaaattcgcgctggttaaaccgaagtccagtgatgtaaaagcactgctgggtcaccgtagtcgtagcgcagcagagttgcgcgtgcaggcgcagtaaggggtagcaacaatgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccgaactggctgaagctcgccaacgaggggcgtatttttgaagcggcggaactgtcgcatcagaccaataccctgccggaagtgtgcggacgtgtctgcccgcaagaccgtctgtgcgaaggttcctgcaccctgaacgatgagtttggcgcagtgaccatcggcaacattgagcgctatatcaacgataaagcgttcgagatgggctggcgtccggatatgtccggcgtgaaacaaaccggtaaaaaagtggcgattatcggcgctggcccggcgggtctggcgtgcgcggatgtcctgacgcgcaacggcgtaaaagcggtcgtcttcgaccgtcacccggaaattggcggattgctgaccttcggtattccggccttcaagttagaaaaagaggtaatgacgcgccgccgtgaaatcttcaccggtatgggtattgaattcaaactcaataccgaagtgggccgcgacgtacagctggacgacctgctgagtgattacgatgccgtgttccttggcgtcgggacttatcagtcaatgcgcggcgggctggaaaacgaagacgccgatggcgtgtacgcagcgctgccgttccttatcgccaacaccaaacagttaatgggctttggtgaaaccaacgacgaaccgttcgtcagcatggaaggtaaacgcgtggtagtacttggcggtggcgataccgcgatggactgtgtgcgcacgtctgtacgccagggtgcaaagcacgttacctgtgcctatcgtcgtgatgaagagaacatgccaggttcccgccgcgaagtgaaaaacgcgcgggaagaaggtgtagagttcaaattcaacatccagccactggggattgaagtgaacggtaacggcaaagtcagcggcgtgaaaatggtgcgcacagaaatgggcgaaccggatgccaaaggccgtcgccgcgcggagatcgtggcagggtcagaacatatcgttccggcagatgcggtgatcatggcgtttggtttccgtccacacaacatggaatggctggcaaaacacagcgtcgagctggattcacaaggccgcatcatcgccccggaaggcagcgacaacgccttccagaccagcaacccgaaaatctttgctggcggcgatatcgtccgtggttccgatctggtcgttaccgccattgccgaaggtcgcaaagcggcggacggcattatgaactggctggaagtttaagcgaggtaacaataaattcgccagacagtgtctggcgaatttataaaacgagcgatccaactaaattttaagccattaaatcagccttaatcttcactaccacctttttaatctcaccaggttcgccaacaacgcatcccggtttatgcggttctcctggcataaacacggcgaacattcccggtttcaggatgatggcttgctcgttttcaatggcgctgcaaagctgataatcatcttcatggtggaactcttcacactgacgcgcagtgcctgccatgccaaacagaatccgttcctcaccgtttaataacagctggatatcaatgtattgttcgtgcaattcggcttttttctcaacaggcgattgagtattaaatgtcatgacattcataaagatattgtcgccctgtaattcgtaacggccaggcgctttttcttgcggtctggcagctaatgccaacgttaacgcgtcctgtaacgcaggatgtaatccggcagacggtaatgactgtacttcacccatcatcataatatttctccctgggccaacagcgcagccccaagtaaacctgcatcgtggcggtagtgcgccgccagtaaatcaacatgaaatgccgctggctcctgcgccagatacgtttccaccagcgccagatacccttctgccagaccaacgctgccaccgaccaccacgcactggcaatcagttgtggctttaatatcagcgatcagccttgcaagcgtacgtgcggagcggtgaatcagttgctgcgcctgctcatcaccctgcccggcgcgcgtgaaaatagttttcgcattcgcaccagccaactccccctgcgctgccgttgcaatgccgcgaccagaagcaatcgcttccacgcaacctgtgcgtccacagccgcaggctggaccatgcggatcggcaagcgtatgcccgatatgccccgccagaccgccagggccggtacgcagtttaccgccgctcactacaccgccgccaacgccggtggaaacagtgataaaaaccatatcggttatatcgccatccagcgcctgatactccgcccatgctgcggcctgcgcatcattaatggcaatggtcggcaaattggtaagttgctccagcgttttgactaacggaaagtgtaacaatccaccgagattatgcggattcagcgccaacaagctgccgtcgcgaataattccggttgaagcgatggcaacccgctgcgcatgtgcttgcaacggagagactaatgcggataaggcatcacgcagcgcctgcggagtctggctggcaggcgtaggaagttctcggcgatcgcggatctgcccgtcagcgccaatcagcgcggcggcaagtttagtaccgccgatatcaatcgccagtgtggtcatagcaccgcctttttcatcgctgtgttgtaccactgacaaatgtgttcaagacgcgtaatggcagaaccgaccgtcaccgcccacgcgccgtggcgcatcgcatccgccgcctgagcaggcgtgttgtaacgcccttcggcaatcacccggcatccggcgtcactcaacgttttcaccagcgccagatccggctcttctggcgtttcaggcgtagtatagccagaaagcgtagtgccaataatttcggctcccagcttttggcatgccaggccgtcttccggcgttgagcagtcggtcatcgccagtaaaccgtgatggtgaatacgtgccagcagcgtttcaactggcaccggacgcggtcggtcggtgccgtcaatcgcgataatgtccgcgcccgcctgcgccagcgcatcaacatcttcaatataggccgtgatgcgtaccggagaatcctccagatcgcgcttcacaatcccaataatcggcacgctcaccaccgcacgcgtggcttgcagatttgccacaccttcaatacgaatggcgaccgcgcccgcctgctctgccgctaatgccatggcggcaacgatttcgggtttatcgagcgggctgtccggaaccggctggcaggagacaatcaggccaccgttagcagcgattttttgatccagttgtgcaagtaacgacatacatcttcccttagcgaaaggcccggtacagagaccgggcaacaggattaacttttggttttgactaaatcgtttttggcgctgccaaacggcacggcaccgctaaatggtttgccgtcgatagcgtcatgagtacgcaatgcttccgggcgcagccaacgctgaacacgagaaggcatatccagaccaatcagcaggatcaccacaaatgtcagactgaacgagagcgatgccagcgcagtacccagatccagacgttgagcgatcaacgcgccgaggattggggccagtgcaccgcccaatgcgccaacgttgtaggtaaagcccaggcccgctgcacgctggtcggtatcgaaataaccgccaatcagtttcggtaagatcccggcgatcccttgtccaagcatttgctggaagaacagtaacagaccgagcacccagacgtttgcgccgccaatcgcaaataccggaataatcagcagctgcgaggccagcagactacaaacgtacgctttgcgggttcccagccagtcaccgaggaagcccccgacgcagcaccccaccgccgcgccaaagccactaaagaacagcacattggcgacagtatgcgggtcataagccagatcggttttcagatacgttggcagcagcgcctgaatcggccatgagtagaggaaagcgaacaacacgaccaccatcagcattacgcccgttggccagcgtttgcccgtactctgcaccataaagctgataaaaattgcggcgcataacagcccaagaacagcgacgatcgcggcattttgcaggttaccggcgaagcagaaccacagcgcagtagccgccgccagtgtcattacgatattggcaatgcgatgttcaccacggtagagaatgtctaccatcgtgcgtactggtgctttacccccgtgtttctctttccagtcttccgcttccgggatgtttttacgcagccagagagcaaagatgattggcaaaatgccgataaagaacagcgcacgccagccccagaccggaaccaccagactatagacctgagcggcaacgacggcccccactgagaagcctgaaatcagaaaaccactggctttgttacgcagatgctttggccagctttcaatgacataggtggcgctggaaccgtattcacccgccatccccatgccgatgaccagacgagcgataaacatggtgatgtagcctggcgcaaagccgcaggccagcgtcccggccgagaagagaacgatgctggtgaccattgccagacgacgcccgtagcggtcacccatagcgccgagcatcaggccgccgaaccagcgagagataaaggctgcggagatcagacttgccgcctgcaccgtcgtcagcccgaattcaccctgtacttcggtgagtaccagggcgattaaaacgaaatcaaaaccgtcaagcagatatcccaaccaggcagcggaaaatgcccgccattgtgcgcggttaagatggcgataccacgggatattctgggttgtagtactcattgtgagtctcccgcggtgggcgatgcccacacgctttggtatgaaaattgtagggtacagatgcgtttatttcccctcacccggtaggggcgagcgaggggaaacaactcacccgcgctcttgcatcaactgctgggccagcgccttcagttctggcagatatttttcatctaccggaccaaacggtttgcggcacagcggcacagaaacgacatccatataatgcaggacagttttcaggccgcggaatacgcccgttttgatcagtaaatcaatgactttgttgcactcagtttgcagtttctgcgcggtctggatatcgccttctttcagcgccttcacgatcccctgataacgccagcccatgatgttgtaagtgctgccgataccgccgtctgcgcccgccagaagaccagaggcgaagatttcgtcgtaaccgttatagagcaccagatcaggatgttcacgacggatctgctccatctgatagagatcgccagaggtctgtttcagcgcacctacaccaggcagcgtaaccagagtgttaatctgatccagggtcagttttaccccgctcagggctggaatgttgtacaccaccatcggcaacccatccgccgaatcaataattgcccgatagtgatcgcagtgttcttcaaagctgaaaggatagtagaacggcgtgacggcggagacggcatcgaagccataacgtttagccgatgccgcaagttgttggctttcggcggtgctgacgcaaccgacgtgggcgatgagtttaatcttacctttcgcctcttcagcgacgatttccagtacctgttcacgctctgaaaggctctgtacaaaggcttcgcctgtcgaaccacccacgtacaaaccgtcgatgccctgctgaatattgaactgaaccaggcggcgcagactcgctttatccagtgcttgttgttggtcaaaaggagtcaggagtgcagccattacgccacgtaaattcgttgccataaatacctctgaagtgatgcttgtctgataaacgatatacctttatacctgttataccagatcaattaagcaacaccccatacagaaagcttataatgcgatctgcttcactaaagtggcattatttctttttgttggtggtctgaccgaaggcgtgccaggtagcagagacgctgttgagatgcgattgcaacgcgcgatcggcttcgtcaggatcatgacggcggatcgcgtcaacgatcgcaatatgctgttgatagctaacgttgttatgctcatgcagagcctgatcggccacggttggacgtgcggcgattagccagtcgagcagggcaacgtggatcgccatgaagattgggttaccggggatctccgccagaacgcggtggaaatcaacgtctgagcgaatgaatgctgcgttgttatccagcgactgactgttgatttccagtgcttttgccagcaaatcgatttgctcatcggtggcgtgttcagccgcatagcgcaccaggctggattcaaagaacagacgtaattgttcgaaatgggcaatcccaccaggatgagaaaggaaatctttcgccatgccggaaagctcgccgatgatggtgtccgcagaaggacgtgagacgcgggcacgttcgccgttgtttatttgcaccagacctttgcgttttaacgctgccagcgcttcgcgcaccgaaggacgcccgacgttaaagaacgccatcagttcgcgttcagacggtaattgttcaccttcgccaaattcacgacggcggatcatctgttccagctcttcttccaccatttcggagagttttttacgcgccagcgggcggctgcgcaagttgcgcccgatagtggtagtagaatcttcagcttgcggatcaaatgcgttcataggactcattcaggaaaatgcgttagcggataataacgacgctatcgtagcacagtatcaaagtcaggcgaaaagatgacagatagcaaaacaggccacatgggcctgttttcattttacttcacaacgcgtaatgccggtcgaccaccgcgtggtggctgcggaggttcatcgtcaggatgagtttcatcatcgtgatctggcttgtcgccatcgataaccgacataacggtttcgttgtctgccgatgcctcttcatcattcatgatgctggcatcttcatcgtaggcagcttcaggctcaaacatcgtgcctgcaccattttcacgggcgtagatagccagcacggcagccagcggcacagaaacctgacgcggaatgccaccaaagcgcgcgttaaagcgcacctcatcattcgccagttccagattgccgacagctcgcggagcaatgttgagtacgatttgcccgtcacgcgcatattccataggaacctgcacgccagggagcgtcacatccaccaccaagtgcggcgtgagctggttatccagcaaccactcatagaatgcacgcagcagatagggacgacgtggtgttagctgtgacaaatccatacagattaactccggcccagacgcatttcacgttcagcttcagttaaagaagcaaggaaagagtcacgctcaaagacgcgggtcatatagcctttcagctctttcgcacccggaccgctgaactcgatgcccagttgcggcagacgccacagcagcggagcaaggtagcaatcgaccaggctgaactcatcgctcaggaagtacggcttctgaccgaagaccggcgcaatcgccagcagttcttcgcgcagttgcttacgtgcggcatctgcttcagaagctgaaccgttgatgatggtgttcatcagcgtgtaccagtctttttcgatgcgatgcatgtacagacggctttcaccgcgagctaccgggtaaacaggcatcagtggcggatgcgggaaacgctcatccagatattccataatgatgcgagattcccacagggtcagctcacgatccaccagggtcggaacgctctgattcgggttgaggtcaatcagatcctgaggcggattgtccttttccacgtgttcgatctcgaaacttacacctttctcagccagcacaatgcggacctgatggctatagatgtcagtaggaccggaaaacagcgtcattaccgaacgtttgttggcagcgacagccatgaaaacctccaggtatagtcagaatttttactgctaccagccaccaggtggccagtcagaagttgtgttacccagtaaggaacgactctctttgttcgaaaatcaaacaaaaaatgagcaatacccgacatttgggcagaaaattggatgatagtttaccagattttgcgacctttgtggtgagtcgatgccggaaatggggaaaaagagatgcgctttagtctgaaatagttgacttagtcccttattggcaatgtggtttttgttttacctgtctgtcaggtggcagcaaaaagcaactttccattttttacgctgatgcagattttagccataaaaaaacccgccgaagcgggttttttcgcaaattgttttctgccggagcagaagccaattaacgtttggagaactgcggacgacgacgtgctttacgcagaccgactttcttacgttcaacctgacgagcgtcacgagtaacgaagccagctttacgcagttcagaacgcagggactcgtcgtattccatcagagcgcgggtgataccgtgacggatcgcaccagcctgaccagagataccaccacctttaacggtgatgtacaggtccagtttctcaaccatgtcgaccagttccagcggctgacgaactaccatgcgggcagtttcacgaccgaagtactgttccagagaacgttggttgattacgattttaccgttgcccggtttgatgaaaacgcgagctgcggaacttttgcggcgaccagtgccgtagtattgattttcagccattgcctataatcccgattagatgtcaagaacttgcggttgctgtgccgcgtggttgtgctcgttacccgcgtaaactttcagtttacggaacatagcacgacccagcgggccttttggcaacatgcctttaaccgcgatttcaatcacacgctcaggacggcgagcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaataaatagttacacgttggtgaacacccaaacgtcttcaattgttgaggttcacacgacaaagtccggcaaacctaccccttcgaatagcctatgccagcacacaaaaagtttcgggaaaaaaaactttcttgtaacgtggggtcgcaggattatagagaagtcggggtcaaagatcgacccctttttgtgatttgtggcaggttttaccccgccaaatgctcgcgcttcaaatactcttcgctttgcatctcttgcagacgtgacaggcaacgctggaactcaaacttcagccgctcgccctgataaatttcatacagcggcacttctgcactcaccactaatttgacatggcgctcgtaaaactcatccaccagcgcaataaagcgccgcgcttcgctctccatcaaccgcgtcataactggtacatcaaacaacatgaccgtgtgaaagaggcgtgagagcgcaatatagtcatgctgactgcgggcgtcgacgcacagcgtagtaaaagaaaccgccagcgtctggttctcgacgcccattgtcgccaatggccgatggttgatttctaacgtcggtgaattttctcgtttcgcccccgccagcgccaaccatagtttatccatttgcgcccgggtttcatcgttgaggggcgaaagccacagatgcgcctgagtgagtgtacgcagtcgataatcaacaccagcgtccacgttcattacatcacaatgccgtttaatagcatcgattgcaggcaaaaaacgcgcacgttgcaggccatttcgataaagttcgtccggcggaatatttgacgtcgctaccagcgttattccgcgagcgaacagggctttcatcaggccgccaagtagcatggcgtcggtaatatcagaaacaaaaaattcgtcaaaacagagcacgtcagtttctgctttaaagcgatcggcaataatttccagcggatcggtctgcccctgcaaagcagttagctcttcatgtacccgcagcataaaacgatgaaagtgcaggcgctgtttccgctctcccggcaggctttgatagaaaaggtccatcagccaggttttcccgcgtcctacaccgccccacatatataagccacgcactggcatatgctttgtgtcttcgcgtttaccccacagcttaccgacccgcgccattagcccactcgtcctgggggctggtggcgtgctattgatgagttcctgataaataatttccaggcggctgacggcctctttttgaacgtcgtcgggttgatggctgccttcattgagcgccttcaggtattgcgatgttggggtaacgctttgcatgatcttattgttattccttgaataatcggtgcgccgttgttcacggttgacgaaaaaaaggccgttctacactacgcgatatgctgtcgggattccacttctgtggaattaacggttatagtggcataatcagccgcaggcatggagcctgaagccaacaccctacggaaacaaaagacaacgggagatgttcatgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcgaaaagctccagtagcctgctgccggaactgtctgcggaagcaaacccgttccgtaatcgtctggcagagtctgaagccagcaacgatcaggcaccggtgcagatgcctcgcgactattctgaaggcgcatccggcctgctgcgtactggcgcgaagcgcgactaatttatttttcgggcgcagccattgcgccctcctcttctctccctccccgactatcatttaatctggtgtctcattgttagccgtctgaaaattcaataacatcaaactgttttgaatctcttttcttatcattcaggtacgagagcaggaataatgaaaaaacaaacccagctgttgagtgcattagcgttaagtgtcgggttaactctctcggcgtcatttcaggccgtcgcgtcgattccaggccaggttgccgatcaggcccccctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccaataaaggctatgtgctgaccaacaaccatgtgattaatcaggcacagaaaatcagtattcagctcaatgatgggcgcgagtttgatgcaaaactgattggtagcgatgaccagagcgatatcgccctgttgcaaattcaaaacccgagcaaattaacgcaaatcgctattgccgactccgataaattgcgcgtcggtgattttgccgtggcggtcggtaacccatttggccttgggcaaaccgccacctctggcattatatccgcattaggccgcagcgggttgaatcttgaaggtctggaaaactttatccagacagatgcttccattaaccgcggtaactccggcggtgcactgttaaaccttaacggtgagttaattggcatcaacactgcaatccttgcgcctggcggcggtagcgtcgggattggatttgccattcccagtaatatggcgcgaacactggcgcagcagcttatcgactttggagaaatcaaacgcggcctgttaggcatcaaaggcaccgagatgagtgccgatatcgccaaggccttcaaccttgacgtgcagcgtggcgcgtttgtcagcgaagtgttgccaggttctggctcggcgaaagcgggcgtcaaagcgggcgatattattaccagcctcaacggcaaaccgctgaatagctttgctgagttgcgctctcgtatcgcgaccaccgagccgggcacaaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggtggcaaaggtattaagatcgatgaggttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcattgccctgcaaattgtacgcggcaatgaaagcctctacctactaatgcgttaatgtcgtaaaccgggcatcaggctgacgtgtgatgtccggttaactcgtggtatgctgctgccgttcccttttttaacgatgcctccatcatgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttataaccgcggtttgaacaccaactctcacaaccagcttgagatccgcaccctgggatctggtgtaatcatggatcaacgcgggtatatcatcaccaataaacacgtgatcaacgacgccgatcagatcatcgtcgccttacaggatggacgtgtatttgaagcattgctggtgggatctgactctctaaccgatctggcggtacttaaaattaatgccactggcggtttacctaccattccaatcaatgcacgtcgcgtaccgcacattggcgacgtggtactggcgatcggtaacccgtacaacctcgggcagaccattacccaggggattattagtgccacgggtcgaattggtctgaacccaaccgggcggcaaaacttcctgcaaactgatgcttccattaaccacggtaactctggcggcgcgctggtgaactcgctgggcgaactgatgggcattaacacgctatcgtttgataagagtaacgatggcgaaacgccggaaggcatcggctttgcgattcctttccagttagcaaccaaaattatggataagctgatccgcgatggtcgcgtgatccgcggctacattggcattggtggacgtgagatcgcaccactgcacgcgcaaggcggtggtatagatcaactgcaagggatcgtggttaatgaagtgtcacctgacggcccagcggcgaatgcgggtattcaggtcaatgatttgattatttcggtggataacaaaccggccatctctgctctggagacgatggatcaggtggcagaaattcgccctggttcggtgatcccggttgtcgtgatgcgtgacgataaacagttaacattgcaggtcaccattcaggaatatccggcgaccaactaaggtcagcgtaaaaaaacaaaaaccggagtctgtgctccggttttttattatccgctaatcaattacttattaacgaactcttcgcccagggcgatatctttcttcagcgtatccagcataccttccagcgcgttctgttcaaatgcgctcagagtaccgatagatttacgctcttccacgccgtttttacccagcagcagcggttgagagaagaaacgagcgtactgaccgtcgccttcaacgtaggcacattcgacaacgccttgttcgccctgcagtgcgcgaaccagagacagaccaaaacgtgcagctgcctggcccatagacagggttgcagacccgccaccggctttcgcttcaaccacctcagtacccgcgttctggatacgtttggtcagatcagccacttcctgctcggtaaaactaacgccaggaacctgtgacagcagcggcagaatggtaacaccagagtgaccaccaataaccggcacttcaacttcgcctggctgtttgcctttcagttccgcaacaaaggtgttggaacgaatgatatccagcgtggtaacgccgaacagtttgtttttgtcataaacaccggcttttttcagcacttcagcagcaatcgcaactgtagtgttaaccgggttagtgataataccaatgcacgctttcgggcaggttttcgcaacttgctgtaccaggtttttcacgatgccggcgttaacgttaaacaggtcggaacgatccatacccggtttacgcgctacgcctgcagagataagaacgacatctgcaccttccagcgccggagtcgcatcttcacctgaaaaacctttgattttcacagcagtagggatatggctcagatcgacagccacaccgggagtcactggagcgatatcatacagagagagttctgaacctgaaggcagttgggtttttaacagtagtgcaagcgcctggccaataccgccagcagcgccgaggactgcgactttcatcctaaactccttattatattgataaactaagatatgttgctccgctgccgcgaccttaatccacaaaattgccgtttacaatgaccacatctcaagaatgtgtagtcacgcaagtttagcgtttatgcatttaattgccgtaatcaggaacctaacttacgtaattaacagtcacttatgcattagcgcaacattccaacaggtggtgacaatataccctaccgctcagccaaaacaatatcaatttgataacaattaatttacttttaagcagaatttgcaggccgtgacgcaggcatgtttctcaataacgaaatttgataaaatcccgctctttcataacattatttcagccttcttcagggctgactgtttgcataaaaattcatctgtatgcacaataatgttgtatcaaccaccatatcgggtgacttatgcgaagctcggctaagcaagaagaactagttaaagcatttaaagcattacttaaagaagagaaatttagctcccagggcgaaatcgttgccgcgttgcaggagcaaggctttgacaatattaatcagtctaaagtctcgcggatgttgaccaagtttggtgctgtacgtacacgcaatgccaaaatggaaatggtttactgcctgccagctgaactgggtgtaccaaccacctccagtccattgaagaatctggtactggatatcgactacaacgatgcagttgtcgtgattcataccagccctggtgcggcgcagttaattgctcgcctgctggactcactgggcaaagcagaaggtattctgggcaccatcgctggcgatgacaccatctttactacccctgctaacggtttcaccgtcaaagagctgtacgaagcgattttagagctgttcgaccaggagctttaatctctgccccgtcgcttctggcggcggggaaaatgttgcttttgcctatcaaccccctgctttcccctgcgattcatttaacgaatagtgcgttttactgcgacatatcattcacacaatgaatacatatagtaaaaaagcacattatgcaaaattcattatctaattgaaaatactataattaacaataaatgatcgtgtttttaattcttttttgttattaaaattcacatttttaacacttagtatcaactgaaacagttagcgtggtattaattagttcaataattagtgtatacttgattttgtgatatgggtcacgaaacaaaggcccagctaaaagattatgtcgaggtaaaaatcatgaaaatcaaaaccactgttgctgcattaagtgtgctttctgttctctctttcggtgcattcgctgccgactccattgatgctgcacaagcacaaaatcgtgaagcaatcgggaccgtatccgtaagtggtgtggcgtcttcgccaatggatatgcgtgaaatgctgaacaaaaaagcggaagagaaaggcgcaacggcctaccagattactgaagctcgtagtggtgacacctggcacgctacggctgaactgtacaaataaaccctcatcgtcttgtccgacgatattgcccccggttcgggggctttttttgcgctaatgacgaacattaaaacgcaaatgcccttccagttcttcctctgcctcatcaaacagcaatattaacgcgccaaaacggcgacgcgttttctctcccagatgaacaaattcaatctcaagtggtagcggcaggacatcgttcattaacacatcccatagtgagtcgagatcgcgtaccttatctttcgccagaccaaaggtttggctaaagtcacgataaaaatcctcctgactctcaatctcatcaaaatcaaaggtataaatattcatctgttgccaccgtcacgtttcgcggcgagttctgccgttcatcgctaagtatagccatgaaaaaaccgacgcttcaggcgtcggttttgacttaactatcggtcaacgcatgttgatacttatggagcatacccgtaagccgatgtactggttccgtcacctgcggtggcgcttgccagatgcgtagcttttcctggtagatttccagttcttccagcaactggccaaagtaccgacgacgtttatcatcgctacgggcagatatcacatggtctgctgtgcggcgcatttgtcggtgaaacgccgataaatcctcgttaaccgggatcggcgcatcacgcaggcgctggtgcgcgataatcatcgtcagcgccaggcgaaatttcggcaaatcccctgggaacttattcatcagcaaaaacagctgctgataaagtgccgggaggtgattctctttacgacgtgccacattggtagtcatcgcggaaacagcggcagaaacaaactgattaagcagtacacgtccagtcctgtcgcgcgatttatcccgcaccagcaaaataacggtgaacgcgagcacacagccgacgatttgccctaatgcgctgtcgagaaactgactgaaatggaaagtcatcgggttatccagcacgataatgtttatggtgctggccaacgcccccatcgagcccaatctccgtttctgtacttctataccgaggaagaatcccagcactgccaggctaatacacagcagcaacatgctctgttgggtattagggataatcaccaaaaagtagagcagccctaacggtagcgctgccagcgtcccgtagataaagtcgatcgccaccatgcgtggattcggcaaacgcattgccagtgacgtcactaccgcaatcatcaccattgcaccactgccggaagtccagcccgtccacagccagaaaagcgtgcccagaatgcaagaaagtgtggttcgccagaagttaaccattgcatgatgacgttcggctgactctacttttacttccggttcgccttgcaggatctcttcttcggtggcgttgatttttgtgttactgataacgccgcgcttgagaagctgataacgcgttgccgccgcgacccagctataaatggtgacaggcgtttcccgttccccggtccaggcgataactctccgcaggcgtttgagctgcttgtggacgtcctgcgcagtttctaccggtgtgtcaaaaaattcgcgaaaagtatcagtgatcaattccgggcgcgtattctgaataagataagtttcgcaggattgggtaatcagcgtcagcgatagcgtattgatcgcttttaaacgtcgattggcccgcgcccagcgggaagattccatattcaggttgctgcgcataccttgtaacgccgtagtacgtcgcaccagatcgccccaggctttatcgacaacttcaccatcgccatgcttgatacagagttgcattaattgatattgcgcgaccagcaaactttccagctctcgatccacttcttgtttgatcgatcgcggagaaaagagcaaatccgccataattgcacacacaataccgataacgatctcgctacaacgttcgacggcaaactgcggcgtaagcaatggttccggctgaatagtgatcacaatgatcagcgcggtataaccggccagcccccacgcatacgagttttctattcgtaccagcgaggatatccaggtacaaaaaccggcccagatacagcacaccagaatcatcaataatggtgctcggatcatcgcaatgatgattaccagtccggcaatacagccaataaatgtgccgatgatgcgcaaaaagccacgatagcgaatagcgccagaatacggttcacctcccgcagcaaaggccggaccggcggcaacaatcgccgctgtcagtaccgcccagcgtggcgtttccagctggaagtgaaagccaacaaacagcgccagtacaatggcggtcgccagttttaccgcaaagcgaatatgttgattagcaatggagaaaatacccatcgtgattaaccaaactcacgcaggcgatgagccattttacggaagaacgaatcctgactttcgtcgcgatcttgtttgccagtgactaccaccgtagcagtggtgcccgcaggccagatgttctcttgctggttgtcgagacgaatacgtaccggaacacgttgcgccaaacgtacccattcaaggttagagtcgatggtcgccatccctttgtcgtcacgcgtgctgctggcattggtgacccctgcggcaacactatcaacagtccctttcagcactttgttactgccaagcggcgtgatctccgcacgatacccagggcgcaccccttccagcttagtttcttccatataggccagtacatagaaggagttctgtttcaccagcgcaaccgccgttgatcctcgagtaataaactcaccggtatagacgttgaggttggtcacccagccatctgctggcgcgcggatgactgtacgttcaagatccagttttgccagatcgcgggtcgcctgcgctttcgctaactgatgcagaactgtttgtagtacgttgttcgcctggtcgatctcttcgcgagacatcgcctgcacaccgagacggttacgacgtccggcctcctggcgtttctcctgtgccagtacctgataataagcaacatcggcttgcgcttcctcaagcgccttttgatagcgcggctggtcgatggtgaacagtacctgtccttttttcaccagctggttatcatgaacattcacctgggtaatgagtccagaaacgtccggcgcgatcgcaacgacgtcagcgctaaagcgcgcgtcacgcgtccacggggattcggtgtaatagacccaggcattaaaaattgcgatgaaggccagaatgactaatacgaccgtgatggccgtacgggagaattttcttattagtgttttcacttcaacctcaaacgaacagtcgcgatatcaaataaaacaagcagcaatagagcgcggtgttgaacaacgccggatgccagacaaagtcgtaaatacctgttggcacaagtacccggcgcaccagccagaaaatcgccagtgataaaagcaattcgaaaaatatcggtgggaaggacagcccaaacaccacgataacgggaaacagactcatgttgaccttggttgtatagagagagcaggcgttattattttcagcatctgtcgccgcagagaagggcatggaaagccgggcgagagcaacattgctgtagattgatatttaatatattaacgtaactgttatgctgttatctatattatgtgatctaaatcacttttaagtcagagtgaataatggaacgactaaaacgcatgtcggtgtttgccaaagtagttgaatttggctcttttaccgccgccgccagacagctacagatgagcgtttcgtccatcagtcagacggtgtcaaaactggaagatgagttacaggtaaagctgttaaaccgtagtacacgcagcattggcctgactgaagccggcagaatttactaccagggctgccgtcggatgctccatgaagtgcaggatgttcatgagcaactgtatgccttcaataacacccccatcgggacgctgcgcattggctgttcttcaactatggcacaaaatgttctcgccgggctgacggcaaaaatgctgaaagaatacccaggtttgagtgtcaatctggttaccggaattcctgcccccgacctgattgccgacggtctggatgtggtgatccgcgtcggcgcgttgcaagattccagcctgttttcccgccgtctgggcgcgatgccaatggtggtgtgcgccgcaaaaagctatctcacacaatacggcataccagaaaaacccgccgatttaagtagtcattcatggcttgaatacagcgtgcgacccgacaatgaatttgaactgatcgcaccggaagggatctcgactcgcctgatcccgcaagggagatttgtgactaatgatccgatgacgctggtgcgctggctgactgcaggcgctgggatcgcctacgtgccgttgatgtgggtgatcaacgagatcaatcgcggggaactggagatcctgctgccacgttaccagtcagacccacgcccggtttatgcgttatataccgaaaaagataagctgccgctgaaggtacaagtcgtgatcaactcgctaacggattattttgttgaggtcggtaaattgtttcaggagatgcacgggcgcgggaaagagaagtaattaatattgtactgttacgttgtacaaacctgtgccaacgggttcccctcaccctaaccccagaggggcgaggggaccgttcgtacacggagaaggattaattatccttctgaaaatactgaaattattacgcagtaccgccaacagtcaggttatcaactttcagcgttggctggcccacgccaaccggcaaactttgcccttctttaccgcagacacccacgccgttatccagtttcaggtcgttgccaaccatcgaaatctgctgcatggtttcgataccggaaccaatcaacgttgcgcctttcaccggcttcgttactttaccgttttcaatcagatacgcttctgaagtggagaaaacgaatttgccggaggtgatatccacctgaccgccaccaaagttcggtgcatagataccgtactcaacggattcaataatttcctgcggggtcgatttacccggcagcatataggtgttggtcatacgcggcatgggcagatgggcgtaggattcacggcgaccgttgccagtcggcgtcatccccatcaaacgcgcgttgagtttatcctgcatgtagcctttcagaatgccgttctcaatcagcacgttgtactggcctggcgtaccttcgtcatcaatcgccaccgaaccacggcgatcgaccatcgtaccgtcatcaaccacggtacacagttctgaagccaccagctccccgacctgtccactaaatactgaagtgccacggcggttgaagtcgccttccagaccgtgacccaccgcttcatgcaacagcacgcccggccaacctgcgccaagtactaccggcatggtgcctgctggtgcggcgacggcagaaagattgaccagcgccatacgcacagcttcttttgcccatgcatccgcacggacttcaccgtcgagatcggcaaggaagaactcataaccaaaacgaccgccgccgccactggcaccgcgttcgcgtttgccatcttcttcgaccagaacgctcacggaaagacgcaccagcggacgaacatccgccgccagcgtgccgtcggtggccgcaaccagaattaattcataaacgccgctgaggctggcagtcacttcttgtacgcgcttgtccgcttcgcgggcaaccttatcgacgcgacgcaggatatccagcttctcttcacggctcatgctttgcagcggatctaccgaggtatacaacgggctatgctctaccgcgcccagcgtctgtactttgccatcaccactatcacggacgatggtgcgcgccgcttgcgcactttgttccagcgccagcaggctgatttggtcagcgtaagcaaatccggttttttcaccgctgattgcacgcacaccaacgccctgatcgatgttgtaagaaccatctttaataatgcggtcttctaaaacccaggattcgtgatagctcgactgaaaatagagatcgccataatcaaggcgacgttcggccagttgaccgaggatcgcgaacaagtcctgatgtttcaggccgttcgccgctagcaattgttcacttaccaggttaagactcatcgtttttgctactcgttagttactgcagtagaggattttttacggctgccggatgcggcgtgaacgccctatccggcctacggttatgttctggctcgttggcctttggcaacgattatcatatgagattggggcaattacgcgccctcgtcaaatcattgcgctttttctttgcgcggttgtcgcaacacttcgttgatttgcggatcgtccagcggacccgaaatgtgatagcgcaaaatggagactttgctccacagcggtcccagcactttactggcggcaaacactgccgcgccaacaatggggttaaccgcaaaggccgcagccacgccgaccgtcgcagaaatctctggtgcgacaaccgcttccatattcaggtcgcgacgtaccagatttaccgaccctttcatagcgatgtccgcttccaggccatccaccagcgtgtcgtcggtgtgcataacgccgtctttaatccacgcggtgctgcgaatggagtcaaaatagaacccttcgccaaaagtgtctctgaaatcaaaacgcagcttacgcatcagggcatctacgctcaataagcgcagcaattgcccggcatgtccggtattgatttcggtaatttcgcctttacccagttgagtatgaatgatgccattcaacgtcgcctcatctggctgccagggtgctttgcgccagtgtaaatcgtaatccacattaaatgacgactggcgtatgggcgtcgtgacaccaaaaaattctgcggcggcatcaattttctgcccgcgcagttttcctttcagcgaggtacgttcattccccggattgttaacccattcaccatcggcagtgagccgcgaaaaaccagtatcaatcagtccattagtcagcgttaacgtatcgccagaaatggtgatatcactgtcaatacgaccgaatttttgcccccagaaccagcactctgcgcatcgtatttgtgcgtctggccagccacggaagttaatgcgttccgttgtcgggaaaggtgatgactgtgttgaatcaccacgagttttcgccacgcttgggttgtaataaagatatttgatattcgccagccacggtgcgttattacgcatcgccagcgtggcgttgatttcacgcccttgcgcctcaaccagggtgccatttgccgtcggttgcgaaacaatactcaggttattccattgctgatttcccagcgacaacataggcgtacgtaacgttatgtgttgtgggaaactcgctgcaccaccgacactctccgccgcgcctttctggaacagggccagccactcggcaccattcatcggcggcatattgagttcaacgccactttgttccggcaacggcgggagcgttttactgtctgccgcccaaatagcacgatcgagcgtcagcttttgaccgagcaaccagcggctattgaaatggttatccgcaccagcctgtccggttaattcaaagctgttgagattgccatcaaccttaacgtttaccgctagtggttcacccgcaggtttggctaacggtgaaggtaagtgactgctcacattcttcaaatcgccgttcagctctacgttataggtcgcgccagcatgataaggcagatcaatgcccactttaccatcccacgccacgctgccactcaatgcttcgttcaccgctacaggcagaacgccggttttcgccggttgccagttaccgttgaggtttaccgctacctggtaggcttttgccccttccttggtggaaaaatccacgttcaacggctgattaaaccagcttgctgtcagtggttcactttgcagatcgccattgataaagctgaatttaccgctcaaatttttcagggtgctgtcgagtggtttgataaacagactgttattacgcagcgtcacttcacctttcgcggttaccaactcgccgttcagcgggatatcaagatgtaagcgagcattcacatcgccgtcgagctggagttcttgcagggtcgcacccagggaatctttcagcggtgtctcatcaaagtaagggccaacggctttacccggacctttaatgtcagcgtcaatcagcagtttttcttttgagtagtcagggatcactgcggtgagattactcgcgcgcacgccgcccagattaacgccatcggttttcatccataaaccgtcgttaataaagtccagttcaatatcaaggttagttaatgcaggccagtccggctggaaggcaaacttcgcgttgcgcagcggcaccagcacttcaaactgaccttcgttgtgtttataggggaagagttgcggattgccaccataaaccagcgtcgcgttatccgcttcaccgccctgaatcgcgccacttaagtaatcaaccaggtctttacccatcaagttttccgggaaatagcgccaggcttgtgaaccatcatcggtactgatgccagccagaatacccagccagggttcatcgttagcaggttgcaggtaacgaaaaccgccgcgcgcatggacggctttggctttaacgtcaatattacgcccatccagctggaaacctttgtcattgttcagccagcttatcgttgcctggccgtcggcgatttccagtggcgcacggaataccgtttcgtaaggcatctttgcctgcttcatcgacgcagtaagcaaaccattttctacgctgccggaaagcgtcccggagaagtgttccgcacccggtaataatttccattgcttccaggccagatcgctccacgatgcctgaaaacgggtcttgtctgccgcctgaagcgggatatccagcgccagagtgttaatcttgccgctcggttgtgtggagcgccaaacatcacccagtgcaggtgaaagtttcgcgaccagcgggcgtacgccctccaggcctgccagctccagattactggcgcgaatccggagttcgtcactgcgtttattgtctttgccgccaacgtcctgttccggtatccaggccagcgtcaatgctccgctcggccagggtttgccgtccatcgtgatccgtgtatcgggaatagagaactgccatcccggattttcacgcgtaatatgcgcagtcagattatccaccgacagcgtatgtgtttccttctcgcccaaccagctggcaccgccctgtttcagccagacgtcaccgccggttacatcgcctttgtcgatcgtcatccagccttcaagggagaactgtgccgtttccagcgcaatattgtcctgcatccatttaccgagccacggcttcaggtcgatgtcatccgcctggagccagacgcgaccattgcttaacaacccctcatcatcgcgcaaatccatacgcacctgcatcacgccgtgctgtccggtaaggctggagaggcttaccaggccttccgcacggtgtcgacgtggatcgttcagccaggtgagctgtgggatcgccagctcggcgcgctgaccggatggcgtcaggaaactgacttcactgtcgcggagatcgaaatggtcaaattgacgaagaaacagatcgctgatgtgactggcttccaggctatcattaccaccgccgctggtgataggagtgttggtgcgaaagcgcagctgccagaaagtgaggtcgcgaaactgccagcgcatatgtaacaggctctgccagacatccagcgcaagagtaacgcgtttaaccgaaaattcgccgccatcttttagttctgcacggatgtcgtgcgcttcaagcgtcggaccaaaattctgccagctggctgagagctgactggcttctaccggcatgccagtcgcggattctattttgttgaggatttccggacgccaggcgtcaagatgcggtaaagcaatacgcaggccgctaaccagcagggcagcgatcacaacgagcgcggctccagtaagcagtaaaatccccggcaatcgcctcacccgtcactccttgtctgctaaaaatgtgactcaaaaaccctttgccggatggcggcccagcatctgtttacatcattacgacgtcaaactgctcctggttatagagcggttcaatttgtactttaacctgtttgccaacgaaaatttccacttccgccagcgagtgtgactcttcgcctttcaaggcttcggctactgccggagaagcatagaccaggaaacggtcggagtcgtaagcatggtggacacgaacaatctcgcgcatgatttcatagcataccgtttccacggttttcaccgttccgcgaccgtggcaggttgggcattcgttacacagtacgtgctcaatgctttcgcgggtgcgtttacgcgtcatctccaccagccccagcgccgaaaaaccattaacgctggttttcacccgatctttgctcagcgcctgctccagcgagtgcagcacgcggcgacggtgatcttcattattcatatcgatgaaatcaataatgataatcccgcccagattgcgcaaccgtaactggcgagcgatagcctgcgtcgcttcaatattggtattgaaaatggtgtcgtccagattgcgatgaccgacaaacgctccggtattgatgtccacggtggtcatcgcttcggtctggtcgataatcagataaccaccggatttcagttctactttgcgttccagcgctcgctgaatttcgttttcgacatcaaagagatcgaaaatcggctggcgtccggtgtaatgctccagcttgctggtcatctcgggaatgtactccgaggtaaactccagcaatgcttcgtaagtcaggcgtgagtcaacgcgaatgcggtcgagttcggcgtcggcgaaatcacgcagaacacgctgcgccagcgccagttctccgtacagctgataacgggtctgcgggcgttttttacgctccataactttggtccagacgcgtttcagataagcggcatcggaggccagttcagcctcgccaaccccttccgctgcagtacggatgataaacccgccctgctcgtcgcaatactctgcgaccacttttttcaggcgttcacgttctgattcgctttcaattcgttgggataccccaacgtgagaagcccctggcataaacaccagatagcgagaaggcagcgtgatatcggtggtcaggcgcgcacctttagtgccaagcggatctttcaccacctgcaccatcagatcttgcccctgacggaccagttccgagatgtcgcgcaccgtgaattgcttttgttcttcacccgccacacattcagtgtgcggcatgatgtcagatgcatgaagaaacgcggctttatccagcccaatatctacaaaagccgcctgcatacccggaagtacacgacttacacgacccttgtagatattgcctactattccgcgtcgcgcctcacgttcaatatgaatttcctgcagaataccgccatcaatatacgccactcgagtttccgaaggcgttacgtttaccaacaattcagccgtcatgtttatcccttttctcacgcagtgcgttaaaattacttaataattcatacgtttcaaccagcggtaagccgactacggcgtgaaagctgccatttatcttcctgacaaaacagccacccagcccctgaataccgtatgcacctgctttatctaacggttcgccgctggcgacatagcccgcgatgtcttcgtctgttaacgttctgaaagtcacatcggtgaccaccaggcaatcgagaatgtgctggctgtcagccaacgccactgccgtcatcacctgatgggtctgacccgataatttgcgcaacatctgcgccgcatgctctgcgtcgcgcggtttctcgagcacttctccgttcaggataacgatagtatccgcacccagcaccgggagatcctgcgccgtttgcgcgacacccgcctgtgctttctcgcgcgccagacgcacaacatactgctgcgcgctctcctgcggctgacgctgctcctcaatgcccgtaacaatacgttcaaaggtcacgccaagttgcgcaagtaactcctgacgacgcggagaaccggaagctaaatacagagaagtcatagaaacctttattgcactgcaaactgctgacggactttacgcatcagcaagaaaatccacggccagagcaccccattgactacactactccagaacacttccggtctgaaagagacgttaatcactaaaaactctgcccagaaaacaataatatccaccaccagcgaaagcaacatgacgaccagcgcctgctgccataatgcgaggttgcggaaaagctggtatttcagcgccaccaggtaagcaatgatgctcatcgccaatacgcgtacgccaagcgtcgagccgctgatcagatccagtatggcacccatcacaaaacctgtgcccacatttacgcgatggggcaaggccaggatccaatacaacaagatgagtaacacccagtttggccggaaaacaatcagattatccggccagggcatgatttgcagcaacagcgcaatgaggaaagagagccagattacccagcgtccctggctacgatagctcgccactattgtcctcccggcgcacgcgcaggcggttgagcaccactttgcggcggcgtagccctttgtggagagcgattagcagcgggctgtgtgggcgcagcaggcgcagtaactgcatttcctgtcgccggttgctgcggagtcggctgagtgatccccgttgccggttcaggtaactttggccccatcgcgtctggcgaaggcaatacctgcggcatcatctgcatcaaacgttcattagcaacacgatgcacctcttccggcgtcatcgggttagcgccgttacgatccgcgccccacagcagcagcagataacgcaaacgttgcagtcctgcagtcggacgcgcctgaatcacagtataagcgcgctgggtatcgagttttacggaagagacaaccgcgaccggatagccttccgggaaacgaccgcccagaccggaagtcaccagcacatcaccaacacgaatatccgtattcgctggcagatgctcaagctgcaaatcatccgtacaaccgttaccggctgcaattacgcggatatcgttgcgcagcacctggattggcagcgcgtgggtcgcatcacaaatcagcagcacgcggctggtcagtttagcgacggccaccacctgaccaacaacacctttgtcgctgatgaccggctggccttcataaacgccattaacgctacctttatcgataacaacttgatcgctataaggatcgttaaccgtggagataacctgagtcaccattttctgctcatcctgacgcagcggggaacccagcagctcgcgcagacgcgcgttctcctgtttgtattgtccaagcatcagcagttcactgtttttcagcaacagttcctgacgtaacgcccggttttcaagttctagttggtcacgcgaggcccagcgtctgcgatacgccatccagcaattcacgaggagcattggaaacaaagtagaaaggactgacggcggtatccatataagtacggatttgactgaacgtccccaggcggctgtcggcaataataatgccgagcgccaccagcaccgccagaataaggcgaatctgtagcgacgggccacggctaaaaattggcttcataagttatgcgtattctcgtatcagaccaggcagggtaaacagacacttcccctgcctgcatccgattactcttcgctgaacaggtcgccgccgtgcatgtcgatcatttccagcgctttgccgccaccgcgcgccacacaggtcagcgggtcttcagcaacaacgactggaatgccggtttcttccattaacaaacggtcaaggttacgcagcagtgcgccaccaccggtgagcaccatgccgcgctcggagatatcggaagccagttccggcgggcactgttccagtgcaaccattaccgcgctcacaataccggtcagcggttcctgcagtgcttcgaggatttcgttggagttcagggtaaaaccgcgtggaacaccttctgcaaggttacggccacgaacttcgatttcacggacttcatcgcccgggtaagccgaaccgatttcgtgcttgatacgttctgcggtggcttcaccgatcagagaaccgtaattacgacgtacatagttgatgatagcttcgtcgaaacggtcaccaccaatgcgcacggaagaggagtaaaccacgccgttcaaggagataacagcaacttcagtggtaccaccaccgatatcaaccaccatagaaccggtcgcttcagaaaccggcaggccagcaccaattgcggcagccatcggttcttcaatcaggaagacttcacgggcaccagcgccctgcgcggattcacgaattgcgcggcgttcaacctgggtcgcgccaaccggcacacaaaccagaacgcgcgggcttggacgcataaagctgttgctgtgcacttgtttgatgaagtgctggagcattttttcagtcacgaagaagtcggcgataacgccgtctttcattgggcgaatggcagcaatattgcccggcgtacggcccagcatctgcttcgcgtcatgacctactgcagctacgcttttcggtgaaccggcacgatcctgacgaatggccaccacggaaggctcattcaatacgatgccttgtccttttacataaatgagggtattcgcagtacccaggtcaatggacaagtcattggaaaacatgccacgaaattttttcaacatactaagggataatcctgaaagctggggcggaaaagaaaatccgcttactttaccaaccacacgcagcagcgacaaggcgcaaaaatcatctgctacggtgaaaattagtgcagttcgtttcctttgttacaaatctctgcctgagtccagaaaggcttaatgcatcagcagcattcctcgcctgtttgcaaccgcgtaaggtcattcatctgcatatgtgctgcaacaatctggcgagcagacaagcacactcccatgagacgcagcgcgcgttattctacgtgaaaacggattaaacggcaggttaaaccgagtatctttgtgaatattttttcacgttagtatcaagtggctgtgaggacgcgaaaaaatccccttgcccacctgtaacaccgcgctgaatcagggtctgccactcgcttcgcgaacgtacgccggtggcgtaaacctgggtgctggtcccggagcaggcttccaccaggctttgaaccagcagctggttctccgttcgcttctcaatgtttctgaccagccccggatggagcttgagtaactcaacattaagttctttgatccaactggtgcttaccagcgtcaaaccagcctggttgacggctacccgtacccctaaagcattcactaaacgaataacaggttgtaagcgactgatatgttgacctacatcggcctctgcaagttcaataattatgcgtcttcgttgcgatttttcacattgcattaacggatcgcgcagccaacgctgaaaacgcgggcgaatcagcgactcaacggtaacctgaatcgccagattttcctctggccagtaacgcaatagtggaataagacggctgattagcaggcggtcatactcttccgataaaccaaactgcaagaccatcggcatatactctgccgagctaacctcttcattaccatcgaagatgcggcacatgagttcacgatgatgaacccggccttcgcgagtaaccgccggtttttgataaaggcgcgggccgccgcgactgagcatttgctcgataagcgtacgccagcgaacattaccgcgtcctttttcaggcaacgagtcatcgtaaatagcccagctattgccgccctgcaatcccgcattacgcgtggcagactctgcatgttccattacctgctcggtatcctgaccactacgccaggcacagataccaatgtggatcatatcgtcgcgatcgagcattttattgttcggcaaggtatcgacggctttgattaactgactggcgatgctctctgcctcttttaacgtccggtgcggtaacagcgcagcaaaatcactgcggtggtaacgcgccagcagtgcgccagggtagcgcatcataaatgtcgatagcagattcgtcagagagaagaactgttcttcaacctggctgtgcccccaggtatcactcaacatattgaaatccggcagacgaatcatcatcacgatcccgtgggtacctactttctcttgatcttccagtaacgttgctaactgattatcgaaaaagagtcggttattgaggccggttttcatgtcctgggcggcataagagcggatcagcgtatcaagacggctgtgttgttcgcgtgcgttctgaatttcacaaagcagcgtatccagcgcactgctggttctgggcggccattcatagatggttcccaacacattagagccacgctcaccgtttaagatacgagtagcccgggtttccagcaattcttgcccggcaagttgccgttgtaaccagcgtaccgccaggaagagcataagaatgataaagccaatcgcccccgtgagcggcgcggtagtcattaaagaatggaaatagttgcccatcggatcctgataaaccagacgcagcgacatccccggatgctttatcaacggaacgctcagttcacgaaacagatcgttggtgccaaccggacgataactaccatttctggccagggtataaacctgcttatcaccatggagcaggtctacacgaacgatatctgccgacatcattaattcggtaatttgtggccttaatgtgctgaagtcattcgacactaggtgggtatcaatcgccgtcgccaccgcctgaacacgatgactaaacttatactgaatggcgttgtagaaacttagcgaacagcccagcaaagtcacaaaaattgttaacccggtgagcagcgtgacaaaggccgaaaatttcgtcgttaatctcatccttgtgttaactccgatagtgaggaagcgggcatactagcaaatcagatttatctcgcaatttattgcgcttcatcggctttgcttttccattagcgagtatagtcttcagaaattattttccaatccatcatgcacatgaggaccacttatgcaggcgttacttttagaacagcaggacggcaaaactctcgcatcagtacagactctggacgaaagtcgccagccggaaggcgatgtcacggttgatgttcactggtcgagcctgaactacaaagatgcgctggcgattaccggtaagggaaaaatcatccgtaattttccgatgattcctgggatcgattttgccggaactgtacgcaccagcgaagatccgcgttttcatgccggtcaggaggtgttactcactggctggggcgttggtgaaaaccactggggtgggctggcggaacaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggatggggagattgtcgtgacgggtgccagtggtggcgtcggcagtaccgccgtggcgctgctgcataagttgggttatcaggtcgttgctgtttccggtcgcgaaagtacccatgaatatctgaaaagtttaggtgccagccgtattcttcctcgcgatgagtttgctgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagcacgccgcgcacaagcctggcagcgactggtcgccgatttaccggaatcattctatacccaggcggcaaaagagatatctctggcagaggcaccgaagtttgccgaggccatcattaataaccagatccagggtcgcacgctggtgaaggttaactaaccatttagcaaggattaataagagagggaactcattttgaaatcattattcaatcggttaacggaaaaagcggttagtcggacagctttcgtcgaacaccttggtcaggaagttgtacaacatcatccaaactggaaagtcatgatttcgactgaccataaattgatgcgcattgatactccaccaaacagccattattgatacgcctccgtcgcctgttaggtttatggtgctttgccttggcgacgctacgcttaatctgttactgatttctggtaccatggggggaataatctgattttatttgattacaaattaaccacttaaacctattgaatgcggaacattgtcagtcggttaattttgcgtgctttagcattcacatctttccggacgatgcagtgaaaattgggtaatccccagcaaccgctgcgtaatgtcgtctatcttgtcgcgatcctggcatccctacattatttgtggtctgtgaagattatctcattgcagccccccatcttcgcagggctggctttacagcttttcaccttacgttataagaagttccgtcgatgatggcgctaatttcgtgaattgtgcggcttgttgcaaattacacggtgttgaaggttatttacatgttagctgttgattatcttccctgataagaccagtatttagctgccaattgctacgaaatcgttataatgtgcgacctcgtcctccctgacgcagtttttgcgctgcggaaaaggtgacattggcgcaacgaaggtatattttgttttttgccggaggatagcagcagatcgctgcacaatgtccgtcaagtctaacattgacactctggggcaaaatagaccggcgtcccggcctgctggaatttatcgctatgcatacagctgtcggggcatacgctttacagacggcggtgaaacgcctgtcacaatcacactaaacaaagagtacggaacccactcatggatattcgtaagattaaaaaactgatcgagctggttgaagaatcaggcatctccgaactggaaatttctgaaggtgaagagtcagtacgcattagccgtgcagctcctgccgcaagtttccctgtgatgcaacaagcttacgctgcacctatgatgcagcagccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaacgaggcgaacatgctggataaaattgttattgccaaccgcggcgagattgcattgcgtattcttcgtgcctgtaaagaactgggcatcaagactgtcgctgtgcactccagtgcggatcgcgatctaaaacacgtattactggcagatgaaacggtctgtatcggccctgctccgtcagtaaaaagttatctgaacatcccggcaatcatcagcgccgctgaaatcaccggcgcagtagcaatccatccgggttacggcttcctctccgagaacgccaattttgccgagcaggttgaacgctccggctttatcttcatcggcccgaaagcagaaaccattcgcctgatgggcgacaaagtatccgcaatcgcggcgatgaaaaaagcaggcgttccttgcgtaccgggttctgacggcccgctgggcgacgatatggataaaaaccgcgccattgctaaacgcattggttatccggtgattatcaaagcctccggcggcggcggtggtcgcggtatgcgcgtagtgcgcagcgacgctgaactggcacaatccatctccatgacccgtgcggaagcgaaagcagctttcagcaacgatatggtttacatggagaaatacctggaaaatcctcgccacgtcgagattcaggtactggctgacggtcagggcaacgctatctatctggcggaacgtgactgctccatgcagcgccgccaccagaaagtggtcgaagaagcaccggcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttactgaaatgatcaccggcgttgacctgatcaaagaacaactgcgtatcgctgccggtcaaccgctgtcgatcaagcaagaagaagttcacgttcgcggccatgcggtggaatgccgtatcaacgccgaagatccgaacaccttcctgccaagtccgggcaaaatcacccgtttccacgcacctggtggttttggcgtacgttgggagtctcatatctacgcgggctacaccgtaccgccgtactatgactcaatgatcggtaagctgatttgctacggtgaaaaccgtgacgtggcgattgctcgcatgaagaatgcgctgcaggagctgatcatcgacggtatcaaaaccaacgttgatctgcagatccgcatcatgaatgacgaaaacttccagcatggtggcactaatatccactatctggagaaaaaactcggtcttcaggaaaaataatttgtgacgcgcggtgtttccatcgcgcttagcaaagaacgtaatcaacgccgggcctgttaacgctgcccggcgtttttattgccgttagctaacggtagcttgcaatttccgctttcaacgcgctaatttcagcatcgccatcaacaattcccagctcaaagcagtatgtctttgtttcccctggctctataaagggcagacgcccctgcgctcgttctttatcacgaccgtcaggaaaactattgctgacctccagccccataacatattcacccgcgcctaaatttttccactggataaagttgggtagctgcatggtgtcgaatttctcgtaaattccccaccccagttcggcgttcaccagcgcaactttactcatcccctgactgtcgctattcaacgtgagatagtaaacctgctcgtcaaaaccgggctgtggggtacaaatctccagatgactggctaacccttccgccgcatgcggagttcgtggcgttatgcttttagccgacagcaagatttctgcctgtggcgataataaagggccagccgtaattaaagtgataaagaatttgcagcggctggcgggtgaaaccatgattagtcaccttgtcttcaatgcgcattacattttcgccataacggcagcgaatggtcctttccagcgtcagattttcaccgaacaatcgtgtttcccgtactttgccattgatgacaaattcaatgctgtcgtcggtccgttctgtgcgataccccacctcttctgctggagtcgcagccaaacgcccgtgtaaccccagcgtttctccttcatcctcacagggcgtgccaatgtagctaagtccgcaggtagtcagtaaccccgcgtaaaagctacgtaaaaacccgttgccctgagactcaaaaaaagcgggggcgacaacaccgttgggggtgataaaagagagcgcagtgtccttgtagctggcccatgcaatatccagcgcgcgatcttttaccaccgtaaatgccagtcccgcaccagtacggacatcaaacgcttctgtaccctttgctctgccactacgtaactcatagtgtttaattccggcaacctgcgagagatcgccaatccacgaccaaatttcgtttttcattgtgctgcttcccgaatggacatgtcatggcgctggatgaacgtttctatttccataaggcgagacgttccctccattgggccacgtcgggttaccgccagtgcaccgcaggcgttggcatattgtaatgcccgatgggcgtcaaaccctagctggcggcaggcaatccatgcgccaccaaaacagtctcccgcaccggtcgggtcaacttcttccaccggatagctctcaacatgaaactgctcattcgcggagtagtaactggctccttgattgccgcgcttcacaatcacctctttaacaccttcttcaagaaaaccagcgattgcacgctccggcgtcgagtgtggcgacaagagcaacacttccccctcactgggcatatagatatccgttaactcaagaacaaagtggagggcatcgcgcatttctggaatatcaagcatttctttacgaatattcgggtcgaaagaaataacgccaccatttgctttaacgatggttactgctttttttactgcgtctaccatatggaatgaaaacagggatgaacccataatatgaaaatgggtacaatccttcagaatattttcatcaacatgctgtgccgataatttaccgcaagcggcattcttgatattaaaaataaaatcgcgatcgccagagttatgataagtaacaaaggcactaccggtggcttccagaggtaagactgaaatccccctgatgtccacaccgtcagcagccagacgatgtatattaatatcaccaaagccatcattccccacgcagctaatgatgccgcacgggacgccaagacgtgtcacctggtcgataaaaatagcgggcgcaccactgggataagggccgttccagatacctggttgatcaaatggctggccgattttactcgccataatttcaaccagaatttctccaattgtgaagaccttactcatatgattaattccttgaaatgattagctgcgttttcttttatttcttacgtcaaaataaacggctacaagaatgactaatcctttaaccaccatctggtaaaaataaggaacattcattaagttcatgccattattaataacgccgatggttaatgcgccgatcaccgtccccaccacggttccatagccgccgttcaggctggtgcctcccagtacagccgcggcaatagcatccagttcgtagctcaacgcggaattcggttgcccggaatagaggcgtgaggcaaggatcatcccgctgatacctgccagcacggctgtaatcataaagactttaattttcaagcgggtgacatttatccctgaataaattgccgcttctttattaccaccagtgatataaatctttcgtccaaaggttgttttagtaagaatgaaatggttaatcagcaataagataattaatatccagattggaataggtatatagagaaattctccattccccagcgccagaaaggcatcatctttaatcatgatgggcataccatcggtcactatataagcgataccacggaagatccccatagtagcaacggtgacaataaacgacgggatccccgctatagccgtcaagccaccatttatcatccccagagtcagtgctgcaataatggataatgggaccaataaaacaaatggaattccccatgaagccccaagcgcagcaaatgtgccaatcaatgcaatggttgaaccgaccgataaatcaatatcgccaagcaaaagcacataagtcattccataggcggtaattgcaattatcgaaacctgaagaataatattagtaatgttattggcggtaaaaaaactgtcattaataaaactgaacagaatgattaacaccaccattccactgaggataccaccatattgcctgaagacttttttaaaattatttgcaatgggaatttccgaaggtttcggactggcaagagttttctctgtcatttaacgtactcctgttgcagcggtcattacctgtatctgcgttaaattttcacatgaataaatatcggcaatcgttttattacgcattaccaccagacgatcgctaagtgccatgacttctggcagttcagaggacaccagaataattgctgtccctgccgcagccagttgacgtatcacgttatagatttcaaattttgcgccgacatccactccgcgcgttggctcatcgagcaataaaatacgcggagttttctccagccacttcgataacacgattttctgttgattaccgccgctcattgctcccactgcctgatgcacagaactcactttagtgttcattctggcaattgattgcagcgtcttcgcctcttcttgtcggtgattgatgagtcccatccgcgaagcgttatattgaaacgccacatggtgcgtgttcatattgacgtcgtgcatcagcactaacccttcttccttgcggttttcggtcacaaaagcaatgccatgatcaatagcctgtttgggattagcgatcctgacttccttaccatcaatcaacacagtcccgtgatacgaaacgaggccaaatagcgccttcatcacatcggaacgcccggcccccaccaggccaaaaaatccgaggacttcccccggacgcacagcgaaactgacctctttaaaaagcgaaggatgggaaagattttttacttccagttttgcaggaacattttcatccggtttttccccaagacgtgctggccaaatatttttcatttcccgaccaaccatttgggcaatcaagtgctggatatcactgtttttcttttcatgcgtagcgatatactcaccgtcgcggatcaccgaaatatcatctgaaatccgcataatttcatccatgcgatgagagatataaataaccgcacagcctcgctgctttaatttttcaataatgttaaacaggatctccgcttcattatcacttagcgaggatgtcggttcatccataatcacgacatccgctgcatagcttaaggctttagcaatttctaccagttgcctatgtgccatcgacatattgccgaccatttccagtgggtctagtggtatgcccaggtccgcgaggagattctggcaatctgcgagcatttttttatcgttaatgatgccaaaacgtcgcggttcattattggcataaatattttccgccacggtcatattattactcaggctcagttcctgaaaaataatcgcaatccctaactggcgagaatgctgcggattattaatggtgatggtttcaccacgtagtgttatcgttccctgggttggcggataaacaccggccagtattttcattaatgtcgatttaccggcaccattctcgcctaataaagtatgcacccgccctttacgtaaagagagtgtaatatcttttaatgcctgaacatgaccaaatgtcttcgcaatatgcgaaacatcaagaataacatccgtcataatgacctcggtgtcacaacaaaacgccaataacgttttgttgtgaggtgaagatatttactatttacctgtataaacgccgggttgtaccgggatcattttttctaccggtttaccattgaggtgatcaacagcggcatcaatggctttagcccccatttgatcgggatattgccgaatcacggccgcaaacgttttttcactgtcaacagcatcacacgcttctttcatgccgtcaaaaccaatgattttgatgttgtcgttatgcgcagattttgctgcgataaccgctgccagcgccgcatcatcaccaaagccaaacagaccattcaggttggcgtttgcctgcataatgttttgcgcagtcgttaacgcttcagcccgcgtaataccaggctgttcagcaacaattttaatatccggtgtatcgcttaaccctttcttaaaaccatcaacgcgcgcaaccaccgattgtagtgccggataagaaataatggctacagtacctttaccatgcaaaagtttacccattaacttgcctgcttcaacgcctcccgcatagttatcggtcgcaacatgcgatacgaccggaacgccttccgcagcgacgtcgacggtgataacgggaataccggccttatcggctttaattatcgctgcctggacgcctttcgaatcgaccggagagacaataatggcatccacttttttagtaataaaatcctcaacatcagaaagttgtttgtttaaatcctggttggcaatagagacacttaaattgacattgtctttttttgcctcttctttcatggcattcgcaagatcaatatagaatggatgttgttgtgttaataatgacgcaccaattttatactcttttgccaacgaactttgcgagaacaatgccaggctcaccaacatagctgaaccaagtaatttaatatttttcataaacaatcctcattgtttttgtagggtacaacgtattaaatttttccttcactaccacagacgccaataatacgaattacgacttctttcatggcggcctttgcgggctgcatatagtgacgtggatcatttgccgcaggattgttgtagaaatatccttttaacgcatcggcaaacgcaattttcaattctgtcgcgacatttactttacaaataccgcgacgaatacagtgctgaacgtcctgttccgataagcccgaagcaccatgcaacaccagcggaatctccactcgctgacgaatctgttccagccgcacaaaatccagtcgtggttcatgcgcatataaaccatgtgctgtgccgattgctaccgccagggagtcaatttgggtacgttgaacaaactctgcagctgcggctggtgaggtataagcggaatctttttcatccacccgcagatcgtcctcctggccgccaagacgccctagctcggcctcaacgctaacatcaaagcgatggcaaaaggtggtaacttcttgcactcgcgcaatgttgtcttcaaatggcaaatgggagccatcaatcatgacagaacggatccctgcgcgaaccttgttaaaaatgtcatcactctcttcatgatggtcgagatgcaggactaacggcaggttgtactcgcgagccagcgattgtactaacgaaattaaacttcccacgccaccataacgatatgtaccgggtgttcccgccagcataacgggagagcgaagttgtgcagcgctctcaacaactacctgtaaagtttcaaggttatgaatgttgaaagcagggacggcatatccctctgactgggcttttttcagcatgtttttgcttgaaataatatacatcgcagctcctgttatttgtcgttcgccttacaaaatgaagaaagagaatcttcactttcattttgaaagcaaactagcacagcaaaagcagcaaaaagcgtgatgcatgtcgaacatcatcaaaataacttacaaaaataacttaatttatttttcactttgcaagtgaaaccaatggaaaccctgcataaatatgaatatattcatttatttttcaatgtattaagctattttcgttgcaatttttgacccatgattttcttttcgaattgtcgatatgattgaaggataactttcaaagaaaaatacaaggggctatagtgttacgcattaaaggccaatgaagagtgttaacgtgccgagaaaatcgtctaacctactgaaacgcagattaaaaattgcagaaattgttgccgcccagggtgaaatcaaagttgatgacttatctgcgcaacttggtgtctctggcgtgacgatccgcggcgatctcagttatctggagcaacagggatatttaaagcgatcatttggcggtgctattgcgacaccactctcctctgaaccagaagcgatacaaccgatcgcgccattgtctctggcacaacaaatggaaatagcacgacattgcgcacggttaattcgcgatcgtgacacgctatttcttggacatgggacaatctgccgtaagatcattccattgctcagcgaagtgaaaaaactgcgtctgatcaccaacgatcccgaacatgcgctgctggcaaatcagtttattgatggcgaaataatactggctggcagtgaaatgctgcgccccgacaccgcactggccggaaaaccgcttgaacaggcacttcagcatttcaccattacacatagcattctggaaatcagccatctggatgctgatggtactttaaatatcaacgttcccagactcgccgctgcctggcagctctgtttcgatcatgcccagaataagacggttatcgttgccgccgatcctgcgccatcaacggctgctatcgggcatttgcatcaggcagaaaatgtgatcgtcagccgcagcattaacgaacaatatcagcaacaattgcagtcggctgatttcgttatcctttataccagtaatgagtgctttacctggtccaatcgcgaaaggcttcaggaatgagaggggttttgtgacaataactatctgcgctatgggcgaattgctggccgagtttttgtcccgcaacccacatcaaaaattcactcagcctggggagtttatcgggccatttcccagcggtgcgccagcaatttttgctgctcaggtggcaaaactgtcccatcgggccatcttctttggatgtgttggtaatgatgattttgcccgactcattatagagcgtctccgtcatgaaggtgtcattaccgatgggatccatgttatgaacaatgccgtcacaggtacggcgttcgtgagttatcaaaatccccagcagcgggatttcgtctttaatatccctaacagcgcctgcggtttgtttactgccgagcacattgataaggatctgcttaaacagtgtaaccatctgcatattgtgggctcatcgttgttctcatttcgcatgatcgatgtcatgcgtaaagcaataacgacgatcaaatcggctggcggcaccgtttctttcgatcccaatattcgcaaagagatgctgagcattcctgaaatggcgcaggctctcgattatttgattgaatatacggatatttttatccccagcgaaagcgaactccctttcttcgcgcgtcacaaaaatctgtcagaggaacagattgttagcgatcttctccacggcggcgtaaaacatgtggcgataaaacgcgcccagcgtggggccagctattacaagcttaaaaacggtacattacacgcccagcatgttgcaggtcacgatatcgaaattatcgatccaacgggtgcaggcgactgctttggcgcaacgtttatcactcttttcttatccggtttcccggcacacaaggcgctgcaatatgcaaatgccagtggcgcgctcgccgtaatgcggcaaggtccgatggaagggatatcctcactggcagacattgaagactttttgcagcagcactgaacggcaattttctgtcagattattttccctgcctgaagacttgccgtagaattgcccgtttctcgtatccccccatgaggaggaccccttccgtggacactcgttttgttcaggcccataaagaggcgcgctgggcgctggggctgacccttttgtatctggcggtatggttagtagccgcttacttacctggcgttgcccccggttttaccggctttccgcgctggtttgagatggcctgcatcctgacgccgctgctgtttattggactgtgctgggcgatggtgaaatttatctatcgcgatatcccgctggaggatgacgatgcagcttgaagtgattctaccgctggtcgcctatctggtggtggtgttcggtatctctgtttatgcgatgcgtaaacggagcactggcaccttccttaatgagtatttcctcggcagccgctctatgggcggtattgtgctggcgatgacgctcaccgcgacctatatcagtgccagttcgtttatcggcgggcctggagctgcttataaatacggcctgggctgggtattgctagcgatgattcagcttcctgcagtctggctttcgctcggtattctcggcaagaagttcgcaattcttgcgcgccgctacaatgcggtgacgctgaacgatatgctgtttgcccgctaccagagtcgtcttctggtatggctggcgagtttgagtttgctggttgcgttcgttggtgcgatgaccgtgcagtttatcggcggtgcgcgcctgctggaaaccgcggcgggtattccttatgaaaccgggctgctgattttcggtatcagcattgcgttgtataccgcctttggcggctttcgcgccagcgtgctgaacgacaccatgcaagggctggtgatgctgattggcaccgttgtgctgcttattggcgtggtacatgccgcaggtggtttaagtaatgcggtagacacgctgcaaaccatcgatccgcaactggttacgccacaaggcgctgacgatattctgtcgcctgcctttatgacgtcgttctgggtactggtgtgctttggcgttataggcctgccgcatactgcggtgcgctgtatctcttataaagacagcaaagccgtacatcgggggatcattatcggtacgattgtagtcgcaatcctgatgttcggtatgcatctggccggagcgttaggtcgggcggtgatccccgatctcaccgtaccggatctggtgatcccgacgttaatggtaaaagtgctgccaccgtttgccgccgggatcttcctggctgcaccgatggctgcgatcatgtcgacaattaacgcccaactgctgcaaagttccgctacgatcattaaagatctctatctgaatatccgtccggatcaaatgcaaaacgagacgcgtctgaagcggatgtcggcggtgatcacgttggttctcggtgcgttgctgctgcttgccgcctggaagccgccagaaatgatcatctggctgaatttgctggccttcggtgggctggaagccgttttcctgtggccgctggtgctgggtctttactgggaacgtgccaacgccaaaggcgcgctaagtgcgatgatcgttggcggcgtgctgtatgccgtactcgcgaagctgaatattcagtacctgggcttccaccctatcgtgccctcgttactactaagtttgctggctttcctggtcggaaaccgtttcggtacatccgtcccgcaagctaccgttttgactactgataaataaagagttttgccatgccttggatccaactgaaactgaacactaccggcgcgaacgcggaagatcttagcgatgcgctgatggaagcgggtgccgtttctatcacttttcaggatacccacgatacgccagtatttgagccgctgccgggcgaaacgcgcctgtggggcgacaccgatgtgattggtctgttcgacgctgaaaccgatatgaacgacgtggtggcgattctggaaaaccatccgctgctcggcgcgggcttcgcgcataaaatcgaacaactggaagataaagactgggagcgcgaatggatggataatttccacccgatgcgctttggtgaacggctgtggatctgcccaagctggcgtgatgtgccggacgaaaacgccgtcaacgtgatgttagacccagggctggcgtttggtacgggtacccatccaactacctctctgtgcctgcaatggctcgacagcctcgatttaaccggtaaaacagtcatcgactttggctgcggttccggcattctggctatcgcggcgctgaaactgggtgcagcaaaagccattggtattgatattgatccgcaggcgattcaggccagccgcgacaacgctgaacgtaatggcgtttctgatcgtctggaactctacttaccgaaagatcagccagaagaaatgaaagccgacgtggtggtcgctaacatccttgcaggtccattacgtgaactggcaccgttaatcagcgtcctgccagtttcaggcggtttgctgggcctttccggtattctggcaagccaggcagagagcgtttgcgaagcttatgccgacagcttcgctctggacccggtcgtggaaaaagaagagtggtgccgcattaccggtcgtaagaattaaccttcgcatcgccgtatggcgacgcagagcgaagtgcgagcgatgtcacaaaaggcacgttaatttgccgattatttacgcaaatttgcgtgccaaaattttcattcataaagaaaaattgagaacttactcaaatttctttgagtgtaaattttagtcactattttctaatatgatgatttttatgagtaattatcgcgctacgctcattttaaatgcaattctttgatccatctcagaggattggtcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaaaattcgcactggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggtgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgctctgatgatgggcatcaaccgtggtacgctgcgtaaaaaattgaaaaaatacggcatgaactaattcaggttttagctaaatgcttgattaaaaaggcgctactcggcatggggaagcgccttttttataggtgtcacaaagggagtgaccatgagaacaggatgtgaaccgacccgatttggtaatgaagcaaagaccatcatccagggtgatgcattaaccgaacttaaaaagctccccgccgaaagtgtcgatctgatctttgccgacccaccgtataacatcggtaaaaattttgatggtctgatcgaagcctggaaagaagatctgtttatcgactggctgtttgaagtgattgcagagtgccatcgcgttctgaaaaagcagggcagcatgtacatcatgaatagcacggaaaacatgccctttatcgatctccagtgccgcaagctttttaccatcaaaagtcgcatcgtctggtcatatgacagttctggagtgcaggcgaaaaaacactacggctccatgtacgaacccatcctgatgatggtgaaagacgcaaagaactacacgttcaacggtgatgctattctggtagaagccaaaaccggatcgcagcgcgcgttgatcaattatcgcaaaaatcctccacagccttacaatcatcaaaaagtaccgggtaacgtctgggattttccgcgcgtgcgttatttgatggatgaatatgaaaaccacccgacgcaaaaaccggaagccttgctgaaacgcattattctcgcctcttccaacccaggcgatatcgttctcgacccgtttgccggtagctttactaccggtgccgtagccgtcgccagcgggcgaaaattcattggtattgagatcaacagcgagtacatcaaaatggggcttcgacggctggatgtcgcgtcgcattactctgcggaagaactggcgaaagtgaaaaaaagaaagaccggcaacctgtcaaaacgaagccggttaagcgaagttgaccccgatctcattgcaaagtaaaggaagtgtaagcctggttttcagattattcatttcgtgtatatttcctgccagacttggttaaacatgcacaggctcaggtaatgattcgcaagtattggtggctcgtcgttttcgctgtcttcgtttttctgtttgatactttactgatgcagtggattgaactgctggcaacagaaacagacaaatgccgcaatatgaactcagttaatccactaaaactggttaactgtgacgaactgaattttcaggacagaatgtgaatttatatgacacttaattcattcgttttatgaattaatttcgttatgttttcatctggcatgaacattcttaatacgttatcgaccagagcgggggcttgtttataaagatcataacccgccatattcattaaccagttttgaacaattccgctgaaggcaccatcaataataatcatcacaacatctaaatcgagattatttgctacacaaccttgttgctgacacgcctgcaatacttcgcggagagtctgcggattaaagcccatcttttcgcgtatcactccctcggccagcatctcatcattaaattcacatttgtgatataagattttcagcaacgcctgctggcggggaattttggcaatatattgcaaaccgacaatcaatttttcacgcaattgctgaaacgggtcatgctctaacccagcggtcaagtgatcctggattaactcccgcaatgaaggctgttgcaaccacatctcattaaacagttgagtcttgttttcgaagtgccagtagatagcgccacgcgtaacgttagcagcgtcggcaatgtcgttgagcgtcgtcttgcttacgccatgctgcgcaaactgggcgatggcagtttcaatcagttcttgccgggtcttcagggcttcagctttggttctttttgccatgattaattattcaggaaataaatatattcgacacaggatgagaaaatagcgaagggttaatctatcacctaatgtgtatttatacgagaggctaatattgcgttgctataaatcgtcaaataaatgatatgtattatttacataaaatacattcacttgacctatacatatttcaatttacgagattttaattctatttctttcattccgcgtcaaaacaaaacagtagaatattaatctttttttgtgtttatgtgccttgagttgccagtattcataactattccttacatcgacgaatgataatttgtaggatagcgaactgtatttttctttctgcgagttaacgcattgcctttttgggcaaataacgcgcttttggttttttgaggaatagtaatgacgaaacatgccaggtttttcctcctgccctcctttattctgatctccgcggctttaatcgccggttgtaacgataagggagaagagaaagctcacgtcggtgaaccgcaggttaccgttcatattgtgaaaacggccccgttagaagttaagactgaattaccaggccgcaccaatgcttaccgtatagccgaagttcgcccacaggttagcgggatcgtactgaatcgcaatttcactgaaggcagcgatgtgcaagcaggccagtccctgtaccagatcgatcccgcgacctatcaggcaagttatgacagcgcgaaaggcgaactggcgaaaagtgaagccgccgccgccatcgcgcatttgacggtaaaacgttacgttccgctcgtgggtacgaaatacatcagtcagcaggagtacgaccaggccattgctgatgctcgccaggccgatgccgccgtgattgccgcaaaagccacagtcgaaagcgctcgcatcaatctcgcttataccaaagtgactgcgccaattagcggacgtatcggcaaatcgaccgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggagaacggtcaaacctatcccctgaaaggtacgctgcaattctccgatgtgaccgttgatgaaagcaccggctccataaccctacgtgctgtcttccctaacccgcaacatacgcttttgccgggtatgtttgtgcgcgcacggattgatgaaggcgtccaacctgacgccattcttatcccgcaacaaggcgttagccgcacaccacgtggtgatgcaaccgtgctgattgttaacaataaaagtcaggttgaagcgcgccctgtcgttgccagtcaggcgattggcgataaatggttgattagcgaaggtctgaaatctggcgatcaagtcattgtcagcggcctgcaaaaagcgcgtccgggagagcaggttaaagccactaccgatacccccgcagatactgcatcgaagtaaggcaatctgacatggcaaacttttttattcgacgaccgatatttgcatgggtgctggccattattctgatgatggcgggcgcactggcgatcctacaattgcccgtcgcccagtatccaaccattgcgccgcctgcggtttctgtttcggcaaactatccgggtgctgatgcgcagaccgtgcaggatacagtgacgcaggttatcgaacagaatatgaacggtatcgataacctgatgtatatgtcctccaccagcgattccgccggtagcgtgacaattacccttaccttccagtccgggaccgatcctgatatcgcgcaagtacaggtgcagaacaaactccagctcgccacgccgttgctgccgcaggaggttcagcagcaggggatcagtgttgaaaagtccagtagcagctatttgatggtggcgggctttgtctctgataaccctggcaccacacaggacgatatctcggactatgtggcctctaacgttaaagatacgcttagccgtctgaatggcgtcggtgacgtacagcttttcggcgcacagtatgcgatgcgtatctggctggacgccgatctgctaaacaaatataaactgacaccggttgatgtgattaaccagttgaaggtacagaacgatcagatcgctgccggacagttgggcggaacgccagcgttaccagggcaacagttgaacgcctcgattattgctcagacgcggttaaaaaatccggaagaattcggcaaagtgaccctgcgcgtaaacagtgacggctcggtggtgcgtctgaaagatgtcgcacgggttgaacttggcggtgaaaactataacgttatcgctcgcatcaacggaaaaccggcggcgggcctggggattaagctggcaaccggcgcgaatgctctcgataccgcgaaagccattaaggcaaaactggcggaattacagccattcttcccgcagggaatgaaggttctttacccttatgacaccacgcctttcgtccagctttctatccaggaagtggtgaaaacgctgttcgaagccattatgctggtgttcctggtgatgtatctgttcttgcagaacatgcgggcaacattgatacccaccattgctgtacctgtcgtgttgttagggacatttgccatactcgccgcttttggttactccatcaatacgctaacgatgtttgggatggtacttgccatcggacttcttgttgatgatgcgatagtcgttgtggagaacgtcgagcgcgtaatgatggaggataaactcccccccagagaagcgacggaaaaatcgatgtcgcaaatccagggcgcgctggtaggtatcgcgatggtactgtcggcggtatttattccgatggcattcttcggtggctcaacaggggcaatttatcgccagttctctatcactattgtttcagcaatggcgctttcagtactggttgcgctgattctcacccccgcgttatgtgcaacattgctgaaaccagtctctgccgagcatcacgaaaataagggaggattcttcggctggtttaacaccactttcgatcatagcgttaatcactacaccaatagcgttggcaaaatcctcggttccacagggcgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagtgacggattactatctgaagaacgagaaagcgaacgttgaaagtgtctttacagttaacggctttagcttcagcggccaggcacaaaacgccggtatggccttcgtcagtctgaaaccgtgggaagagcgtagtggtgacgaaaacagtgcggaagcagtaatccatcgtgccaaaatggaattgggcaagatccgcgacggttttgtcattccatttaatatgccagccattgttgaactaggcacggcaacgggtttcgactttgagttaattgatcaggctgggctgggtcacgatgccctgacccaggcccgtaaccagttgcttggcatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgttgggtgggacttacgttaacgacttcatcgaccgtggtcgcgtgaaaaaggtgtatgttcaggcggatgccaaattccgtatgctgccagaagatgtcgataaactttatgtccgcagcgccaacggcgaaatggtgccattctctgcctttaccacttcacattgggtgtatggctctccgcgactggaacgctacaacggtctgccgtcaatggagattcagggggaagccgcgccaggaaccagttccggcgatgctatggcgttgatggaaaaccttgcgtcaaaattaccggcgggcattggttatgactggacgggtatgtcatatcaggaacgtttatcgggaaaccaggctcccgctctggtagcaatttcctttgtggttgttttcctgtgccttgctgcactctatgaaagctggtcaattcctgtctcggttatgttggtcgtgccgttagggattgtcggcgtgctactggcggcaacactctttaatcaaaaaaatgacgtctactttatggtgggcttgctaacgacaattggcttgtcggccaaaaacgctattttgattgttgagttcgctaaagatctcatggagaaagagggtaaaggtgttgttgaagcgacactaatggcagtacgtatgcgtctgcgtcctatcctgatgacctctctcgcctttattctcggcgtattaccgctggctatcagtaacggggccggcagtggcgcgcaaaacgcagtcggtatcggggtaatgggcggaatggtctctgcaacgttgctggcaatcttcttcgtgccagtgttctttgtggtgatccgtcgatgctttaaaggataaatcagaaacataaaggcgctttcaggcgccttttttattttcagtgaaccccataaaaattaataagatattcttcttctcactctttaaaaactttctatagttcccgctcccttcactatttttacaattcacataaattgtcattattcattccgcaagatttataacctccagtgataaaatggcattcagctcgttaataagagagttaacttattaagcgttagcgtttattactgaggtaacaccatgaaaagattaattcctgtgacattgctcaccgcattgctggcgggctgtgctcacgattcgccctgcgttccggtttatgacgatcagggtcgtctggttcacaccaatacctgtatgaaaggcacgactcaggataactgggaaacggctggggctattgccggcggggcagcagctgttgctggcctgacgatggggatcatcgctctgtcgaaataactaaacagggcgcggagctccgcgctctttttaacgatacagtatctttccataagataaaatattgctatattctgctgggtaattccctgctgatttagcatgttatatcacgttatttcgctgctttcgaaataacgcatcaatttaactttcacacatcccaccagaaatatactcacgctaacaatcattattctgcttagtaaaaaacgcgtaaatattttgcgccaaaatgtggcgcatgtttcattttcgcaccattgcggggcgctgtttttattatttcctgtctacactcagcttattgcgacgcgaaatcgtgcgcaaaagctggcactacttttgcttataagaggatggccacagacaggtaaaagacgtttcccaaacgtcctataacgataattttcgcctcacaggaagcattatgaaaaagatgatgatagccacactggctgccgccagcgtgctgcttgccgttgcaaatcaggcgcatgctggcgcgacgcttgatgccgttcagaaaaaaggttttgtgcaatgcgggatcagtgatggattacctgggttctcttatgccgatgctgacggtaagttttcaggtattgatgtagatgtttgtcgtggtgttgccgctgctgtattcggtgacgatacgaaagtgaaatataccccgctcactgcaaaagaacgcttcaccgctttacagtcaggggaggtggatttgctctcccgtaatacgacctggacttcatctcgcgatgccgggatgggaatggcatttactggcgtcacttattacgacggcattggcttcctgacgcacgataaagcggggctaaaaagcgcgaaagaactggatggcgctaccgtctgtattcaggcggggactgataccgaactcaacgtcgccgattacttcaaggcaaataatatgaagtacacgccagtaaccttcgatcgctcagacgaatcagcgaaagctctggaatcaggccgctgtgatactctggcctcggatcaatcacaactgtatgccctacgcatcaaattaagcaacccagctgaatggattgtcttaccggaagttatctctaaagaaccacttgggccggtagttcgtcgtggcgatgatgaatggttctcgattgtacgctggacgcttttcgccatgctgaatgctgaagagatgggcatcaattcccagaacgtcgatgaaaaagcggctaatccagcaacgcctgatatggcacatctgctgggtaaagaaggcgattacggcaaggatctgaagctggataataaatgggcctttaacatcatcaaacaggtgggtaactactcggaaattttcgagcgtaacgtaggttcagaaagcccgctgaaaattaaacgtgggcaaaataatctctggaataacggcggtattcagtacgcgccgcccgtgcgttaagtcggtgtgaggtaacgagcgtcgctacggcggcgctctcttcagcgttatgctttccgaggtttctatgtctcatcgccgctcaaccgttaaaggctcactctcttttgccaaccctacggttcgcgcctggttattccagatccttgccgttgttgctgttgtcggcattattggttggttatttcacaacactgtaacgaatctcagtaatcgcggcataacatcaggatttgcttttcttgaccgcggggccggttttggcatcgttcagcatttgattgattatcagcaaggcgacacttacggacgcgtttttattgtcggcctgctcaatacgctactggtttctgcattgtgtattgtgttcgcttctgttttgggcttctttatcggtctggcgagactttcggataactggctgctacgaaagctttccacaatttatattgagatcttccgtaatattccgccattgctgcaaatcttcttctggtactttgccgtgttgcgcaatttgcccgggccacgccaggcagtgagcgcactggatttggtgtttctgagcaatcgtgggctttatattccgtcgccgcagctgggagatgggtttcttgcgtttatcctggctgttgttatagctatagtcctttctgttgggctattccgctttaataaaacacaccagataaagaccggacaactgcgccgcacctggccgattgccgcagtgttgatcattggtttgcctttactggcgcaatggctttttggcgcagcactacactgggatgtcccagcccttcgaggctttaatttccgcggcgggatggttttaattcctgaactggcagccttaacgctagcactttcgatttatacctctgcatttatcgccgagattatccgcgcagggatccaggcagtgccttatggtcaacatgaagcggctcgatcactgggattacccaacccggtaacgctacgccgggtcattattccccaggcattgcgggtgattattccaccgttaaccagccagtatctcaacatcgtcaagaactcctctcttgccgccgctattggctatcccgatatggtttcgctgtttgctggcaccgtgctgaaccaaacggggcaagccatcgagacgatagccatgaccatgtcggtctatctgattatcagcctgactatctcgctgctgatgaatatctataaccgccgcatcgcgatcgttgaacgctaaggagtcatgatgacaaaagtattgctgtctcatcccccgcgcctggcgagccataactcaagccgcgcgatggtgtgggtgcgaaaaaatctgttctccagctggagcaatagcctgctgactattggctgcatatggttgatgtgggaactgatcccaccgttgctgaactgggtatttttgcaggctaactgggttggctcaacgcgtgccgactgcacaaaatccggtgcctgttgggtcttcatccacgaacgatttggtcagtttatgtatggactttacccacacgaccaacgctggcgaattaacctggcattactgattggccttgtttctatcgcaccaatgttctggaaaatacttccgcatcgcagtcgctatattgcggtctgggcggtgatttacccactggttgtctggtggctgatgtatggtgggtttcttggtcttgatcgggttgaaacccggcaatggggcgggttgacgctaactttaattattgcatcagttgggattgcgggggcgctaccgtgggggatcttactggcgttaggtcgccgctcccatatgccgattgtgcgtatcttatcggtcatttttatcgagttctggcgcggcgtaccgctgattaccgtattgtttatgtcttcggtcatgctgccgttgtttatggcagaaggcaccagtatcgacaaactgatccgcgcgctggttggcgtgatcctatttcagtcagcatatgttgcggaagtcgtgcgaggcggattgcaggcgctgcctaaagggcaatatgaagcggcagagtcgctggcattgggttactggaaaactcaggggctggttattctgccacaggcgttgaagctggtaattcctgggctggtaaataccatcatcgcactcttcaaagataccagtctggtgatcatcatcgggttgttcgatcttttcagtagcgttcagcaggcaaccgttgatcccgcctggttgggtatgtcgacggaagggtatgttttcgccgcgctgatctactggatcttctgtttcagcatgtcacgttatagccaacatctggaaaaacgttttaacaccgggcgtacaccgcattgaggacactatgagccaaattttactgcaacctgctaacgcgatgattacgctggaaaacgtcaataaatggtatggacaattccatgttttgaaaaatataaatttaatcgtgcaaccgggcgaacggatcgttctgtgtggcccttcaggttccggtaaatcgacaaccattcgttgtattaatcatctggaagaacatcaacagggacggatcgtggtagatggcatcgaacttaatgaagatatccgcaatattgagcgcgtcaggcaggaagtgggaatggtctttcagcatttcaatctcttccctcatctgaccgtgttgcagaactgtaccctggcaccgatttgggtacgcaagatgccaaagaaagaggctgaagctctggcgatgcattaccttgagcgggtgagaattgccgaacatgcccagaagtttcccggacagatttctggtggtcagcagcaacgtgttgccatagcacgttcgctgtgtatgaagccgaaaattatgttgtttgatgagccaacgtcggcgctcgatcctgagatggtgaaagaggtgctggatacgatgattgggctggcgcagtcgggtatgacaatgttgtgtgtaacacatgagatggggtttgcacgaaccgtcgctgaccgggtgatttttatggatcgtggggaaatagtggagcaagctgcacctaatgaattttttgcgcatcctaaatcagagcgtacgaggacatttttatcgcaggtaatccattaattgaatgttagttcgaaaagcaaaaaggccatcctttcggatggcctttcgcttgatttgatgtctggcagttccctactctcgcatggggagaccccacactaccatcggcgctacggcgtttcacttctgagttcggcatggggtcaggtgggaccaccgcgctactgccgccagacaaattcttttctaatctgccgaactttaacctaaaaagtggtgctgatacccagagtcgaactggggacctcacccttaccaagggtgcgctctaccaactgagccatatcagcacgctaaatttgatgcctggcagttccctactctcgcatggggagaccccacactaccatcggcgctacggcgtttcacttctgagttcggcatggggtcaggtgggaccaccgcgctaaggccgccaggcaaattctgtttcattaacccgcttgtcgccggttaatctaatctgtatcaggctgaaaatctttctctcatccgccaaaacatcttcggcgttgtaaggttaagcctcacggttcattagtaccggttagctcaacgcatcgctgcgcttacacacccggcctatcaacgtcgtcgtcttcaacgttccttcaggagactctaagtctcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtacctttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgnnnnncattccattcattaattaattaatgaatgaatgnnnnnacgtgatgttatcaggtgtgtttaaagctgttctgctgggcaataccctgcagtttcgggtggtcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcatacagagtgtatcccggatcttcaccatctttcagtttgaagcaaaccgccgggatgccttcgtccgggcgacccgtacagatgaactcatacggccccagtttggcgatttcatccgccagataagcagcaacctggtaggaagcgttctgtactttggtatagccttcacgaccgaggcgcaggaattcatagtactgtgcaatcacctgacccgccgggcgggagaagttgatggcgaaagtaccaatctgaccgccgaggtagtcaacgttgaacaccagttcctgcggcagcgcttcttcatcacgccagataacccagccgcagcccagcggagccagaccgaatttatggcctgaagcactgatcgatttcacacgcggcaggcggaagtcccagacgatatccggggcgacgaacggtgccaggaagccaccgctggcggcgtcgatgtgcatgtcgatgtcgataccggtgtcggcctggaatttatccagcgcatcgtgcagcggctgcgggaactcatagttaccggtgtaggtcacgccgaaagtcggcaccacgccgatggtgttttcgtcgcaggcttcaatcatgcgtttcgggtccataaacaactgaccggggcgcatagggatctcacgcaactccacatcccagtagcgggcgaatttatgccagcagatttgtaccggaccgcacaccaggttcggtttgttagtcggcttacctgcagcttccatacgcttgcgccaacgccatttcatcgccatcccgccgagcatacaggcctcggaagaaccaatggtgttggtgccaacggcctgaccatttttcggtgcaggcgcatgccacagatcggcaaccatgtttacgcaacgcaggtcgattgcagcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcaacatcatcgcgcatttcgtgcagcggaaatcgttttgattctgcgatagtagaaatggcctttgnnnnncattccattcattaattaattaatgaatgaatgnnnnnacgtgatgttatcaggtgtgtttaaagctgttctgctgggcaataccctgcagtttcgggtggtcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcatacagagtgtatcccggatcttcaccatctttcagtttgaagcaaaccgccgggatgccttcgtccgggcgacccgtacagatgaactcatacggccccagtttggcgatttcatccgccagataagcagcaacctggtaggaagcgttctgtactttggtatagccttcacgaccgaggcgcaggaattcatagtactgtgcaatcacctgacccgccgggcgggagaagttgatggcgaaagtaccaatctgaccgccgaggtagtcaacgttgaacaccagttcctgcggcagcgcttcttcatcacgccagataacccagccgcagcccagcggagccagaccgaatttatggcctgaagcactgatcgatttcacacgcggcaggcggaagtcccagacgatatccggggcgacgaacggtgccaggaagccaccgctggcggcgtcgatgtgcatgtcgatgtcgataccggtgtcggcctggaatttatccagcgcatcgtgcagcggctgcgggaactcatagttaccggtgtaggtcacgccgaaagtcggcaccacgccgatggtgttttcgtcgcaggcttcaatcatgcgtttcgggtccataaacaactgaccggggcgcatagggatctcacgcaactccacatcccagtagcgggcgaatttatgccagcagatttgtaccggaccgcacaccaggttcggtttgttagtcggcttacctgcagcttccatacgcttgcgccaacgccatttcatcgccatcccgccgagcatacaggcctcggaagaaccaatggtgttggtgccaacggcctgaccatttttcggtgcaggcgcatgccacagatcggcaaccatgtttacgcaacgcaggtcgattgcagcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcaacatcatcgcgcatttcgtgcagcggaaatcgttttgattctgcgatagtagaaatggcctttgnnnnncattccattcattaattaattaatgaatgaatgnnnnntttctctttgttgttacgaccatcttgtgaagtgtttcacgttgtcgtctcaacggaggcgcattatagggatcccaattttttgcacaagtacttttttgatctttttttctgtttgttgctttttcaccctttttgctgcattcgcacacaaaacggtgcttttttgcatgctaaaagacttgcacaaggccaataatgcacccaaagtcattagtaaatcatttattgttgaggtgagtatgtctgatgttttacgcccataccgcgatctttttccacaaatcggtcagcgcgtaatgatcgacgatagcagcgtcgtgattggtgacgttcgtttggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagcctggtcccacaaaataaacggctggagagcggatatctgtatctcggtagccccgtcaaacagatccgcccgttaagtgatgaagagaaggctgggttacgctattccgcaaataactacgtgaaatggaaggacgaatatctggatcaaggtaaccagacccaaccttgatcatcttcactttgttcctgaattaagttttccgcttcttcttccaggtcccagcgatgctgacgaaaactcgctaaccactgttctggcgtatctccagtaaagcgatacgccagactctcgccagagatcgcacatgtcagttgcataccattcacgagagcgggaaaacatacacatcttttattctcgtcccactcttccctatccggaaactggatggcctgattcacgctgacaattcctgttgcaatagtttgatgaccggttctacatcaggcagaacgccatgccaaagaaggaaggcatgagccgcctgtgccaccagcattcctaaaccatcagcattacgctttgagcctcgctgctcacaccatgccagaaaaggagtttttcctttctgatagaacatgtcatagcaataaatgcctggatgaatgagcgatgacgggatcgccggaatatcaccactgatgccactggatgttgcattaataatgagatcaaactcatgaccttccagttcgtccatacccaacgcctgaatactgccagtgtgcgcaaacaatttagtcaactcttctgcgcgagataccgtccgattagtgattgtcaccgcacagtccagggaaaggagtggcagtagtacgccgcgagatgctccaccagcgccaatgagcagaatacgtaaaccaggacggataaaagacagacgttccagatcgcttaacaaacctataccatcggtattgtcacccagcaggcgtccatcttctaaccgcttgagggtattaacagcaccagccaacgctgcccgttcagtaagctcatccgctctggcaaaagcctcttctttaaaaggtaccgtcacattcgcacctttaccaccagcactaaagaaagcgttcagtgtgttgatgaaatcattgatgggtgccaacacgcgtccatagggatgttcaatattcagttgctgagcaaattgctgatgaatgaatggcgatttgctgtgggctatcggattaccaaaaacagcataggtttccattatgttacccctgtcgaaacagttcacccgtcagggcatcgcggatttctgaaggatttaaacgcccccccgtttcaccaggcacaaccgggaacgccgcgccaaattgtgcgcgaacttcgtctactgttcgacaaggtggcaatccactcaagttggcactggtagaaaccagcggtttaccataagcctggcacaaagcaaccaccaacggatggtcggtgactcgtacagcaagcgaatcaaagcggcccgtcaaccagcgcggtgttgtcgcaggcgcgggaaaaacaaaggtgacaggacctggccagcgagaaaatatagtttcacgctgcgcgtcagtcagcatggtgtcatcaatatagggtttaagctgctcgtaatttgcggcgattagaatcagccccttatcaaccggacgctgttttaactccaacagtcgcatcactgctgtttcgctatcaggatcgcacccgacaccgaaaacggcttccgttggataggcgatgacacgttcttcattgaggacatctatcgcagctgcgatagcgtctccttgcaggttattattcacgttattattccgccgaaatcggctttccacattgtttactggcacaaaagtgttttacaccctgcgcggttttcttttcgatgagtagcggataatggcactcagggcattctccagctatgggtttgaagttaatggcaaattgacactccgggtagcgatcacaggagtgaaatgttttgccataacgggagcggcgctgaaccagatggcccgtccggcattgggggcatgtaattgctgtttcgtccggtttatcgataagttcggtatgttcgcattcagggtagttactgcaaccaataaacataccaaagcgtccctggcgtaataccagatttgcgccacatgcagggcaaacctgcccctccagaactttgacaatatgtccatccgctgaagatttcagaggacggacgtagtcacacgccggatactgtgagcatccaagaaacggaccgtgtttcccggatcgaataactagttcagccccgcactttgggcaggactcattattacgcaccgtgaacagtgctgatttcgccataactacttatgctgaattaaagaaatgattaatgcagcataccttcattcacttcaaagagtaattcttccatttgctggtacgcattttcgcagcccggaatattgaacaacaccatcaggattacccatttcaggtcttccaggtcgaactcagcggtatccagcgcgagcactcgctctatcaccatttcacgggtttcaaggttaagcacctgaatttgctcaaggaaaagcagaaaaccacgacagctggcatccagtctttcacactcttcaggggtataaatacgcatggagagtggatcagaggccagttgcatcggttctgccagtccttcctgataatccgcaagcttttccagccaaagcagggcattgtagatatcttctcgatcaaatcctgcgtcggtaagatcctgttcaagtttgtcttgatccacacgcaactcagcttctgtgtgaatataggtttcaaacaaatacattagtacgtcgaacatggcatgccctcctcaatcggacatagccgccgggtacagctgcgatccatcctgctaactccagttcgagtagttgagtaactacctctggcacaggttggccggcacgttcagcgacgacgtcaacaggtgttacctcatctcctacgttagccaggagctcaggaaatggcaatgccacgtcttcctgatctggtgaataaaatgaattttcaggggcgtctggcaaccagtgcaatccaaattgcaagttttccagaatttcttccggttccgtcacaagaatcgcaccttgttttattaaccagtgaggcccttcgcttcccggattccctattggacctggcaaagcaaaaacttcacgcccctgctcaagcgcacaacgtgctgtcaccagcgaaccactgcgcaaagccgcttccaccaccagtacacctttacttagaccactgataatgcgatttcttcgtgggaaattgtaagcaaggggtggaacatcgaggggaaattccgagacgagagcaccaccttgctcaagtagactggcagccagtggagcatggcggcggggatgaatggtattaagtccattccccaatacagcaatgctaacgccatttacctgtaaggccgctttatgcgccacaccatcgattccacgcgccagtccactcgtaattgtcactccacgcgtcgccagagtttcgcaaaataatcgtccccatcgctcgccataccatgaatgcgcccgactccccactacggcaagctgaaatgaatgcaacgcgtgcagttctccttcaacaaacagtgcgccggggtaatctgtcgtcgccagaagttgaggaggataaaattcgctgtccgcagggattaaatgatggttgggttgctccaaccaacaaagtgagctttcgatactctttcgcggaaatgaaagaaagcgttgtgcctgccgcaatgtaagccctgtttgctgcaatacaaccgcatcaatatgcgactgttttgccagccagtgagctatacggaccatatcatcgccatacaagctgctgatgctaattaaacgcagccaaatttctgtatcaaccatccttatctccctgccataagcagccttagcaatctttgcgattggtcagtgatgctgtcaatcagagggggatttgtctagaatagaagaaataatctttctaactcctgaacacatctctggagatttatgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgtaattgatgtttcggaaaaccgtgacgaacggctggtgttaatcaatccggagcttttagaaaaaagcggcgaaacaggcattgaagaaggttgcctgtcgatccctgaacaacgtgctttagtgccacgcgcagagaaagttaaaattcgcgccctggaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaaggataagaattaacgtgtcagaatcactacgtattatttttgcgggtacacctgactttgcagcgcgtcatctcgacgcgctgttgtcttctggtcataacatcgttggcgtgtttacccagccagaccgaccggcaggacgcggtaaaaaactgatgcccagcccggttaaagttctggctgaggacaaaggtctgcccgtttttcaacctgtttccctgcgtccacaagaaaaccagcaactggtcgccgatctgcaggctgatgttatggtcgtcgtcgcctatggtttaattctgcctaaagctgtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgttggtttagacaccggtgacatgctttataagctctcctgcccgattactgcagaagataccagtggtacgctgtacgacaaactggcagagcttggcccacaagggcttattactacgttgaaacaactggcagacggcacggcgaaaccagaagttcaggacgaaactcttgtcacttacgccgaaaagttgagtaaagaagaagcgcgtattgactggtcactttcggcagcacagcttgaacgttgcattcgcgctttcaatccatggccaatgagctggctggaaattgaagggcagccggttaaagtctggaaagcatctgtcatcgatacgacaacaaaggctgcgccaggaacaatccttgaagccaataaacaaggcattcaggtagcgacaggtgatggcatcctgaatctgctctcaatgcaacctgcaggtaagaaagcgatgagcgtgcaagacctcctgaattctcgtcgggaatggtttgtaccgggcaaccgtctggcctgatagtccactcttctaagcccggtcttaccgggcatctttatatttatacttatgaaaaaacaacgtaatttacgtagcatggcggcccaggccattgaacaagtcgttgagcaagggcaatcactgagcaacattctgccaccgctccagcaaaaagtttccgataaagataaagctcttctccaggagttatgctttggcgtactgcgtacgctctcacagttagactggctgattaataagctaatggcccgtccgatgacaggcaaacagcgtactgttcattacctgattatggttggtttgtatcaactgctttatacccgcattccacctcatgccgcgctggctgaaacggttgaaggcgcagttgcaattaagcgcccgcaacttaagggattgattaacggtgtattacgtcagttccagcgtcagcaagatgagttattagccgagtttaatgccagtgatgcacgttatctgcatccttcctggttgctgaagcgtctgcaaaaggcgtatcccgagcagtggcaatccatcgtcgaagccaataaccagcgtccgccaatgtggctgcgcgttaatcgtacgcatcattcccgcgacagctggcttgcattgctggatgaagcaggaatgaaaggtttcccgcatgcggattaccctgatgctgtacagctggaaacacctgcacctgttcatgcgctacccggttttgaagaaggatgggttaccgttcaggatgcttcagcacaaggttgcatgacctggcttgctccacaaaatggtgaacacattctggatctttgcgccgccccaggcggtaaaacaacgcatattcttgaggttgctccagaggcgcaagttctggcggtcgatattgatgagcagcgcctctctcgcgtttacgacaatttaaaacgccttggtatgaaggcaaccgtaaaacaaggtgatggccgttacccttcccaatggtgtggtgagcaacagttcgatcgcattttattagatgcaccttgttcggcaactggtgtaattcgtcgccatccggatattaaatggttacgccgcgatcgcgatatcccagaactcgcgcagttgcagtctgaaattctcgacgccatctggtcgcatttaaaatccggaggaaccctggtctatgccacctgttcgatgttaccggaagagaatagcctgcagattaaagcctttttgcaacgtaccgctgatgccgaactttgcgaaacaggaacaccagagcaaccgggtaaacaaaatttgcccggtgccgaagagggcgacggcttcttttacgctaagctaatcaaaaagtgatgagataacgggtcgcgactgatgaaaattatcattctgggtgccggccaggttggcggcacactggcggaaaacctggttggcgagaacaacgatattactgttgtcgataccaacggtgagcgtctgcggaccttacaggataaatttgacctgcgagtcgtgcaagggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgttccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttgcagaatacgatcgtcttttttggtgatgcgtcggatcaagaactgctggccgaagaacatatcgatcaagttgatctgtttattgccgtcaccaacgatgacgaggccaatatcatgtccgccatgcttgccaaacgtatgggtgcgaaaaaggtgatggtattgatccaacgtcgcgcttatgtggatctggttcaggggagcgtgatcgatattgcgatttcaccacaacaagcaactatttctgcgttgcttagccatgtgcgaaaagcagatattgttggtgtttcctcattacgccgcggcgtagcagaagctattgaagccgttgctcacggtgatgaaagcacctcacgcgttgtcggcagagtcattgacgaaatcaagctaccgccaggaacgattattggagcggtggtacgtggaaacgatgtgatgattgccaatgacaatctgcgcattgagcaaggcgatcacgtaattatgttcctcacagataaaaagtttattaccgacgtcgaaagactcttccagccaagtcctttcttcttgtaattaataaggcgtctaatgacgccttattatttccctttgattattaaggattaattaaatccattcctggcaggaaaatggcttaacatttgttagacttatggttgtcggcttcatagggagaataacatgagcattattaaagaatttcgcgaatttgcgatgcgcgggaacgtggtggatttggcagtgggtgtcattatcggagcggcattcgggaagattgtatcttcactggttgccgatatcatcatgccacctctgggcttattaattggcgggatcgactttaaacagtttgctgtcacgctacgcgaggcccaaggggatatccctgctgttgtgatgcattacggtgtcttcattcaaaacgtctttgattttctgatagtagcctttgccatctttatggcgattaagctaatcaacaaactgaatcggaaaaaagaagaaccagcagcagcaacacctgcaccaactaaagaagaagtattactgacagaaattcgtgatttgctgaaagagcagaataaccgctcttaacaagcgtctgaaagcagaaggccagtggtaaaaaagtgatttactttcttgccactggcctcccagttcccccgattgccatgttttccttttcgcatgtaactgcctttccctttcttatttttctctactcgctgtcggaataagggatcatgtagtaatgcttctatcgcattatcctttatctgccctttagtatgctgatatcggctcataaaaactccagttggttatttaacggcgcgagtgtaatcctgccagtgcaaaaaatcaacagccactcttaacgccactcgccccttgttcaagagcttcaagaatcgagcaataaacactgctatgggcggtcccacaacaggtatcattaaggcgttgcaaggaacgctgcatactctgcaactcggctatacgagcttcgacttcctgcaatcgttcctgcacaatgccttttgactcctgacaggtatggtgttccggatcgatacggatcgacagcaactcgcggatcgactccagactgaaacctagttgtctggcatggcggataaatttcaatcgctggagatcgctttcggtatacaggcgaaacccaccttcggtgcgtacttcatgctccatcatctgctgcttttcgtaataacgaatcgtgtcgggtgttacttccgccatttttgccagctcaccaatgcgatacatacatactccactagttatcgttgattttgttcaacaacttgtcagcataatcgccgcgtaaaaaatcggtactcaatccagcttgtcgcagcttcaattccagtaatgacaatcgacgactaacctcttgatattgcggatcatcatgacggatacctttgagaatatccagaagctgtattgcttccctcctatgctcaagttctggcggtaagcaaccagcattcttcagcaagcgataccccgcacgtaattccggtggcacatgagaatcatcatccagtatcaatggttcgccgctacctaccaggttatcaaactcacctttcgcttgcgcttctgctatatgacgctctgcccactggtcaagtaaccacataaatactccaggggatgaataaaaagagtacagctattgtagataagtggggatgctacgggtataaaaaaacccgccggggcgggtttttttacgttgcttcagattactctgcagcagcttctgctttctctgaacgatcaaccagctcgatgtaagccatcggcgcattgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcagagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcgcctcttcaggatcgattgtgccgttggtttccatttcgatgaccagcttgtccaggtcggtacgctgttctacacgcgctgcttcaacattgtaggcaatacgctccacagggctgtagcatgcgtcgaccagcagacggccgattgggcgctcatcttcttccgaatgaattcgggtagaagccggcacataaccacgaccgcgctgaactttgatacgcatgctaatagacgcgttctcatcggtcaggtggcagatcacgtgctgcggcttgacgatttcgacatcaccgtcgtgggtgatatcggctgcagtcacagggccaatgccagatttattcaaggtaagaataacttcatctttgccctgaactctcaccgccagccctttcaggttgagcaggatttccaggatatcttcctgaacgccttctttggtgctgtactcatgtagtacaccatcaatctcaacctcggtcaccgcgcaacccggcatcgatgagagcagaatacggcgcagtgcgttacccagagtatggccaaagccacgctctaaaggctcaagggtcaccttggcgtgcgtcgaactcacttgctcgatatcaaccaggcgcggttttagaaactctgtcacagaaccctgcattgtgtcctctctttggtactaagctttacttggagtaaagctcgacgatcaggtgttcgttaatgtccgcagacagatcagaacgctccggcttacgcttaaacgtaccttccatcttgccagcatcaacttccagccaggttggcttttcacgctgctcagccagctccagagcggctttcacgcgagactgcttcttcgctttctcacgaatgcttacaacgtcattcggactaacctgataagaagcgatgttaacaacacgaccgtttaccataattgctttatggctaaccagctgacgtgcttctgcacgagtggcaccgaagcccatacggtatacaacgttgtccagacgaccttccagcagagccaacaggttttcaccggtgttgcctttcagacgtgctgcttctttgtagtagttacggaactgacgctccagcacaccatagatacggcgaactttttgcttttcacgcaactgcacaccatagtcagacagacgcggtttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaacaaacctggaaaacgaggcgttatacgcgacgttttttcggcggacgacaaccgttatgagggatcggagtcacatcagtaatgttagtgatgcggaaacctgcggcgttcagagcacgaatagtagattcgcggcctggacccggacctttaaccataacttccagattcttgatgccgtattctttcacggcgtcagcgcaacgctctgctgcaacctgtgctgcaaacggagtggatttgcgagaaccacggaaaccggaaccaccggctgttgcccaacccaacgcgttaccctgacgatcagtgatagtcacgatggtgttgttgaaagaagcatggatatgagccacgccgtcagagacttgttttcttacacgtttacgtgcacgaattggtgcctttgccattattcaatcaccccgattatttcttgatcggtttgcgcggacccttacgggtacgtgcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgtccttcagacagctcactgatcttaacatcttcagcgatacccgctgcagccaggatggctttagaacgggtcttgccgacgccataaatcgaagttaatgcgattacggcatgcttatgatcaggaatgttaatgcctgctatacgggccactatgcactcctactatttaatatgtacgttccatgctgaaaagcccgttttcaggatactcaaatggaaacgcacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccaattatcggccgtagcctttcaggttcgccttcttcaatgcagactcatactgactggacatcatcagagtttgcacttgagccataaagtccataatcacgacaacaacgataagcagtgaggtcccaccgaagtagaacggtactttcattgcatcacgcatgaactccgggatcaggcagataaaggtaatgtacagcgcaccaaccaaggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttcgcgtagtttaccacaatgcggcgttgaccacgctcaacaaatacaacaaagaacgtcactgcaaatactaatactgcaaccaacagcaacacgaggaagtgcacgtcgccttgacgcgcttgctcgatagtatgggcaatggctggcgagagtcccgcgacaataccggcgaagataatgatgaaataccgtgccgatacctcgttcagtgatctgttcgcccaaccacatcaggaacatgatttcctgtgaccagacttacacagcggtgaagtagaatgcaaagcccgggttaatgaccaggccttgcataccaggcatattcggcagaccggtagcaataccgatcgactggaatattgccagcaccagagtaccgtagcgggtgtactggctgatcttacgacgaccagactccccttctttcttaatttctgccaacgttggatgaaccaccgtcagtagctggataatgatcgacgccgaaatatacggcatgatccccagagcaaagatagaagcacggctgagagcaccaccagagaacatgttaaacatctcaatgatggtgcctcgctgttgctcaagcagtttggcaagtacagcggcatcaataccagggatcggaataaaagagccaatacggaacacaatcagcgcaccgataacaaacagcagtctgcgtttcagctcgcctaagccacctttggcactttgaaaatctaatcccggttgtttagccatctgctacttattcctcgattttaccgccagcagcttcgatagcagcacgagcgcctttagtaacacgcaggccacgaacagttaccggagtcgttacttcgccagccaggatcactttcgcgaactcgatctggataccgataatgttagccgctttcagcgtgttcaggtctacaacaccgccttctactttagccaggtcagacagacgaacttcggctgtaatcgctgctttacgagaagtgaagccgaatttcggcagacgacggtacagaggcatctgaccaccctcgaaaccgcgacgtacgccaccgccagaacgagatttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgatcataccgcgaatagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcgatagttgcacgaaccacgttaatcgggttggtggaaccatacgctttagccagaacgttatgaaccccagcgacttccagaacggcgcgcattgcaccaccggcgatgataccggtaccttcggaagccggctgcatgaatacgcgagaacccgtatgaacacctttaacagggtgttgcagagtaccgttattcagcgcgacgttaatcatattgcgacgggctttttccatcgctttctggatcgctgctggaacttcacgcgctttaccgtaaccaaaaccaacgcgaccgttaccatcgccaactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtcagctcgccgtttttacctttgatcgtaataacctgaccgttgatttttacgtcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagacccgccataactttcggcagctcatctttacgtttatagatgcgcagacctgggcggctgacacgctgaatgctttctacaacagctttgccctggaaatacttcagagtaagttccagttcaggcttggtgtcgccttcaactttaaaatcttcaataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacagcgttccaacgatcttcgtcggaagcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgtcgcattgaagattgctacgttggaaacctgaatagcggcttctttttcaacgatgccacccggttggttcagggccggaaccggcttctgatgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcactacgaagctcacgagttaccggcccaaaaatacgcgtaccgataggctgctcgctgttgttgttcagaagaacacaagcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaatccccatatcgagggcgcggcattataacaccgcttcaaggatatgggtagaaaaaataaacggctcatttctgagccgtttattcgtatcgagagagtgtactgtattacagaaccgctttctctacaacgcgaaccagcgtccaggatttagtcttggacagcggacggcattcgcggatttcaaccacgtcaccgataccgcattcgttgttctcgtcatgtacgtgcagtttggtcgtacgcttgatgaatttaccgtagatcgggtgtttcacaaaacgttcgatagcaacaacaatggatttctccattttgtcgctaacaacgcgaccttgcagagtacggattttatcggtcattacgcacccgccttctcgttcagtaaagtcttaacgcgtgcgacatcgcgacgcacttgcttcaacaggtgagactgttgcagctggccacttgcagcctgcatacgcaggttgaactgctcacgcagcaggttcagcagctcggtgttcagctcttcaacgctcttctcacgcagctcttttgctttcattacatcaccgtcttagttacaaaggtggttttaatcggcagtttcgctgctgccagcttgaatgcttcacgggccagctcttccggaacaccgtccatttcatacaggactttacccggctgaatcaaggcaacccaatactccacgttacctttacctttacccatacgcactgccagcggcttttcagtgatcggtttgtccgggaacacacggatccagatcttaccttgacgcttaactgcacgggtcatagcacgacgtgctgcttcgatctgacgtgcagtcagacgaccacggccaacagctttcagaccgaagctgccgaagctaacatccgtaccctgcgccagaccgcggttacggcctttgtgcattttacggaattttgtacgctttggttgtaacatcagcgacgctccttatttacggcctttacgctgctgctttttaggctgagcagccggtttttccggttgttcaacagcagccataccacccaggatctcgcctttgaagatccacactttaacgccgattacaccgtaagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttaatacctttagcgcccagacgcattgcgttctgtacagcacgcttcatagcacgacggaacataacgcgacgttccagctgagaagtgatgctgtcagcaaccagttttgcgtccagttcaggcttacgaacttcggcgatgttgatctgtgcaggaacgccagcgatgtccgctacgaccttacgcagtttttctacgtcttcaccttttttaccgataacgatacccgggcgagcagtgtgaatggttacacggatgctcttagccggacgctcgataacgatacgagatacggacgctttagccagttccttagtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccgaccatttcgtcggttacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctaccgggttcatcgcggtaccgcgaacggtcggacgaacaccacgccagcgtgcagcacctgctttacccagaacgcgcagcatatgctcagcattgccaacttcgcccagagttgcacggcagtctgcttctactttacgcatttcaccagaacgcagacgcagggtgacataagcaccatcacgagcaacgatctgaacgtaagtaccagcggaacgtgccagctgaccgcctttacctggtttcatttctacgttatgaacagtagaaccaaccgggatgttgcgcatcggcagggtgttacctggtttgattgcagcatcaacgccagactgaatctggtcgccagctttcaggcctttaggggccaggatgtaacggcgttcaccgtctttgtacagaaccagcgcgatgttcgcggaacggttcggatcgtactcaagacgttcaacaactgccgggataccgtctttgttgcgtttgaagtcaacaatacggtaagcctgcttgtggccaccaccgatatgacgagtggtgatacggccattgttgttacgaccaccggatttgctgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttcacgaatcatgccagcatctcctcaacttgcttaacagcatcagcagtcattacgactttgtcgaaggcgatcaggctaaccgggtcgataccagttgcatcgcgtacgtcaaccttgtgcaggttgcgcgcagccaggaacaggttctcgtccagctcaccggtgatgatcagcacatcttccagagccatgtctttcagtttctgtgccagcagcttagttttcggcgcttctacagagaacttctcgacaacgatcagacgatcctgacgtaccagttcggacaggatgcttttcagcgcgccgcggtacatcttcttgttaactttttgactgtggtcctgcggacgagcagcaaaggtcacgccaccagaacgccagatcgggctcttgatagaaccagaacgcgcacggccggtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcgcctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtgtccagcttcaggcttggtcacacggttagcttttttagcaccggtggtcacctgaatagcacggtagccatcgttagccaggtctttaacctgagtaacgcggtttgcttcaacttcgattacggttactgggatagaaacgccgtcttctgtgaagatacgggtcatacccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcaagtgagtacggatttcgtactgatcgcgcgcgtctttgttgacgtgcggggagatcagaacagtgaagcgctctttgcgtgtcggcagcgggatcggaccacggacctgcgcaccagtgcgcttagcagtctcgacgatttccgcggttgcttgatcgatcagacgatgatcaaacgctttcaggcggatacggattctttggttctgcatgagaccagagctccaattattttataaacgaaaatgattactcctcagacccattacgattgatgggagagtgtaaccgttcttacgtagctccccgattgggagcattgttaggtagccaaattcggctaactgaggttcagattgaacctgctgtcaactacgacaagcccgcgcattatacatacttaaccaccgaacgcaagcgtattgctagtaaagtaaacagcctttgggttatctctcaagttcgttcagcgcatttttgacacgctctcttaaaccggctttctcgtcgctttcttctacagtattttcttcgtcttcagaagaagagggggcattctcaaccgcgacgcctggttcatcttcctcctcgacggattcgacgacggggagtggctgttttttgaaaaaatagtgttgtgttgattgtttaaaagcgggcgtttcagcatctacagtgacttctgcttttactatccaaagtgcccatagctgccgggcatacccaccaaccaacaccattcctgcaaaccacaggcaaatcagcaataaacaaatgacatatattatggtgctgtgtttttgtcgggagaagataccagggtgacccgtttctttctgctcacgcgcggcgatatagaattcaaacatgtcatttccccttcactgttgtttctggggaaatatttgcttcatcccgatataagtaggcactctcccccgccacctgccagagatgtactaacgttgaaaagccaacaacaccgtcagttttcaagtgatggcttttttgaaattgctttattttttctaccaacaagggacgccactctgccgaagattctgtcgaaatatgcaatgcgcggtttaacatcgtttccagccagagaatctcttcctcgctgctatcacgcataatggtactctccccttccggcgacattttccacaacagaagataatcacccgtccataccaactcaaaccatttatgtgtcagcgtccaggtttgctgccctacgagtacatcaacggtagcatcaccgacgcgaacgaccacaacaggcaattttttgtccccgactttaagcgatgcgatccagggcaaattctgatctaccaatgtttgtaaagaagcgttcccacttttacataccagccccgctcttactgcctgatcgcaccaggccgaatcggctggaacctcgtacccccatacgccgtataacacgcttagcgcctcactatcgcgcatcaccacatgagcaatatccttagtcatatcttgtttaactactggcgttacgggtatcagccacgcaggaacgggtaacggagctgtgaaagaggacagcagtagccaaccacaggtaagtgcgagaatggttccactcatcaccacggcaagctgcattttccgggggcgcttatcacctaatacgcggtaaatcattcgccattgttttgcagtgaaaacgcgggtctgctcggcttgctgtaataagctaattgtttcgccggcaagcgccagctttctgcgatctccccgacataataaagctatccgtttcagaactctggcggttaaaaggagatcgggctggtcaatattctgaccttcaaggatgcttgccttaagctcgtgctccgtcagacgacctgtcgagacaagttcaatgccctgttttttaaaatcacgttcaacttttcgatcgggtctgccgatcagcaaaaattgaccgtcaggaataagagatatcgcgcgttggagatcatcaagtatgcggcggtgattcaggtgagcattttcaataataataagagggcagcgactatcagttcgatgaagtgcatgcagtaattgacccgccatctcatctcgcgtccaggcgctgtcacggcagccctgttcagccgcattatcgtcggtaacgatccatgcggccttaccttgccaggaaacaacgaggcttaaagtaatcacacggcgatgtttatctttttgtagttgctgcgccagccaggtttttccacttccagcctcacccaacaaatagcacagacgccaggtctgacgtttctcacgcaaccaggaaagaatgacttctcttctcgtagacatagaacttcctgttttaattattgattatccttaatcataaaaataatgtatgtatttattaattaaatacatattactaatataaataaattttgcttgattcatgcaagcggcattaatactatttatactaacgtcaatatacaacccacccaatctattttattagaacatacatcgtgcccacactacctttccctttccatctggcgaatcataataaagatgctgccatcaatatattgattatatttataagcatagggttgattatttttaatgtgaattatttccatacaactatagttaaaaatgaacagatcattaatcaaccaacaaatgcatttcagtctgaattcagccttgccgctttatggcgcaacgaaaatcatgctggggtaaaagatgcaaatcccgtggcagttaatcaggaaacacctaagctctctatagcgcttaatggcattgtactcacatcgaatgatgagacttcttttgtcttaattaatgaggggaacgaacaaaagcgatactccctcaacgaagcccttgagtcagcgccgggaacgtttattagaaaaataaataaaaccagcgttgtgtttgaaactcacgggcattacgaaaaagtaactctccatccagggctacctgacatcatcaagcagcctgattcggaaaatcaaaatgtactcgccgattatattatcgccacacctatacgtgatggagaacagatatacggtcttcgattgaatcctcgtaagggtctcaatgcatttaccaccagcttgctgcaacctggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcgcggaacttacaggaatgaatggacagcgcaatgaagggactcaataaaatcacctgctgcttgctggcagcactactcatgccttgtgcaggacacgctgagaacgaacaatacggcgctaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacactggacaatggttttctgaaagtggtgcgctcagctaatgtaaaaacatcgccagggatgattgctgacagttctcgtccaggcgtaggtgatgagttggtcacccgaatcgtaccgcttgagaacgttcctgctcgtgacctggctcccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcatcagcggaagatctcgccgagattcttaatcaattaatcagcgaaagccacggtaaaagccagatgcctgccctcctttccgcgaagattgtggcggataagcgaaccaactctcttatcatcagcgggccggaaaaagcacgccagcgcataacttcattactgaaaagccttgatgtagaagagagcgaggaaggaaatacccgggtctattacctgaaatatgctaaagccacgaatctggtggaagtgctaaccggtgtttccgaaaagctgaaagatgaaaaagggaattcgcgtaagccttcttctacttctgcgatggataatgtggccattaccgccgatgaacagaccaactcgttggtcattaccgctgaccagtccgtccaggagaaactcgccacggtaattgcgcgtctggatattcgccgtgcacaggtgctggttgaggcaatcatcgtcgaagttcaggatggaaatggactcaacctcggcgtgcaatgggcgaataaaaacgttggcgcacagcaatttaccaatacgggattaccggtttttaacgctgcgcaaggtgtagctgattataaaaagaatggcgggatcaccagcgcgaatcctgcctgggatatgtttagcgcctacaatggcatggctgcaggcttcttcaatggcgactggggcgtattgttgactgcgctggccagtaacaataaaaatgacatcctcgccaccccgagcatcgtaacgctggataataaactcgcgtccttcaacgttggtcaggatgtgccggtgctatccggctctcagaccacttctggggataacgtctttaatactgtcgaacgcaaaacggtgggcacaaaactcaaagtcactccgcaggtcaatgaaggcgacgcggtactgctcgaaatagagcaggaggtttccagcgttgactcttcgtctaattcgacgctcggcccgacatttaacacccgtactattcaaaacgccgtgctggttaaaaccggtgaaacggtggtcctgggcggattgctggatgatttttctaaagagcaagtgtcaaaggttcctctgcttggcgatattcctttagtgggacaactcttccgctatacctcgaccgagcgcgctaaacgcaacctgatggtatttatccgtccgacgattatccgtgacgatgatgtttatcgctcactgtcaaaagagaaatacacccgctaccgccaggagcaacagctgcgaatcgacgggaaatcaaaagcgctgattggctcggaagatttgccggtgctggatgagaacacgttcaacagtcacgctcctgcgccatcgtcacggtgaggcattcttatgagaattcactcaccgtaccccgccagttgggcgctggcacaacgaattggttatctctattcagagggcgagattatttatctcgccgatacgccattcgaacggttactcgatattcaacgtcaggttggccagtgccagaccatgaccagcttgtcacaggctgattttgaagcccggctggaagcggtgttccatcagaataccggtgagtcgcaacagattgcgcaagatatcgatcaatccgtcgatcttctctcgctttcggaagagatgcccgcaaatgaagatctcctgaatgaagattcagcggcaccggttatccgcttgatcaatgctattttgagtgaggccatcaaagaaaccgcctccgatatccacattgaaacctatgaaaaaacaatgtcgatccgttttcgcatcgacggcgttttgcggacaattttacagccaaacaaaaaactggcggcactgcttatctcccgaattaaggtcatggctcgtcttgatatcgccgaaaaacgtattccacaggatggacgtattagtttgcgtatcgggcgacgtaacatagatgtccgcgtatccacactgccgtccatctatggtgaacgcgccgtgctccgtctgctggataaaaacagcctccagctttcattgaacaacctggggatgacggcagcggataaacaggatttagaaaatctcatccagcttccacacggtattatcctggtgaccggaccgacaggctccggtaaaagtaccacgctctacgccattctttcggcgctgaatactcccggccgcaatattctgacggtagaagatcccgtggaatatgaactggaaggcataggacaaacgcaggtgaatacccgtgtggatatgtctttcgctcgcggcctgcgcgccatacttcgccaggacccggatgtcgtcatggtgggggaaattcgtgatacagaaaccgcgcaaattgcggttcaggcctcgctcaccggccatctggtactctcaacactccacactaacagtgcatcaggcgcagtgacccggctccgcgacatgggcgtcgaatcattcctgctttcgtcttcactggcagggattatcgcgcaacgtctggttcgtcgtctgtgtccgcaatgccgacaattcacgcctgtatcgccgcaacaagcgcagatgtttaaacatcatcagctcgcggtgacgacaattggcactcccgtaggctgccctcattgccatcaatccggctaccaggggcgcatggcgatccacgaaatgatggtggtgacgccggaattgcgggccgctattcatgaaaatgtggatgaacaagcactggagcgactggtccggcaacaacacaatgccttaatcaaaaatggcctgcaaaaagtgatacgcggtgacacctcctgggatgaggttatgcgcgtcgccagtgccacgctggagaacgaagcatgaattatcgctatcgcgccatgacccaggatggtcaaaaattgcaggggatcattgatgctaacgatgaacgtcaggcacgactgcggctgcgtgaagaagggcttttcctgttggatattcgcccccaaaaaagttcgggagtaaaaacacgtcgcccgaggatcagccatagtgaactaacgcttttcacccggcagttggcaaccttaagcgcagcggcattacccctggaagagagccttgccgtaattggtcaacaaagcagtaataatcgactggctgacgtgttaaatcaggtacgcagcgccatccttgaagggcatcccctttccgatgcgttacaacattttcccacgcttttcgattcgctctaccgtaccctggtaaaagcgggcgaaaagagcggtctgctggccccggtgttggaaaagctggctgattacaatgaaaaccggcagaaaatccgcagcaagctcattcagtcactgatctacccctgcatgctcactacggtggcgattgtggtcgtgattattctcctcactgctgtcgtgcccaaaattaccgaacagttcgtgcatatgaagcagcaactgccactgagtacacgcattcttttaggtctgagcgacacgttgcaacgtaccggcccgacattattagcgacagtatttattgtcgctgtgggtttctggctctggttaaaacgcggcaataaccgccaccgttttcatgccatgttactgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgcctggcaaatgcggcagaaaacgttcgccagggtaacagcattcatctttcactggaacaaaccgcaattttcccgccgatgatgctctacatggtggcctctggcgaaaaaagcgggcaactcggcacgttaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaaggaaatcatatgcgcgcaacggataagcaacgcggttttacattactggaaattatggtggtaattgtcatcattggcgtactcgccagcctggtggttcccaacctgatgggcaataaagaaaaggcggataaacaaaaagccgtcagcgatattgtggcgctggaaaacgccctggatatgtacaagctcgacaatcatcgctatccaaccacaaatcaggggcttgaatccttagtagaagcgccgacactgccaccgctggccgcaaactataacaaggaaggttatatcaagcgtctgcctgccgatccctggggcaatgattatgtcctcgttaatcctggtgagcatggtgcatacgatctgctttcagcaggacccgatggtgaaatgggaaccgaggacgacatcaccaactggggtttgagcaagaagaaaaagtaagtcagcgatgaatcagcaacgcgggtttaccctgctggagatgatgctggtgctggcgctggtcgctatcacggcaagtgtggtgctcttcacatatggtcgggaggatgccgccagcactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctgggttccattacaagaagatgccgcagacgagagcaaaaatgactggggtgaagaactctcaattcaacttcagccatttaaacctgatgacagcaaccaaccgcaggtggtgattctggccgacggacaaatcacgcccttctctttgttgatggctaatgccgggaccagtaagccgctcctgacgttagtcagttcaggctcatggcccctggatcaaacgctcgccagagatacccgcccatgaacaaacaatcagggatgacactgcttgaagtcttactggcgatgagtattttcaccgctgttgcgctgactttaatgagcagtatgcaagggcaacgaactgccatcgagcggatgcgtaatgagacgctggcattgtggatagcggataaccagcttcagtcacaagattcattcgacgaggaaaacacgtccagttctggcaaagagttaataaatggcgaagagttaataaatggcgaagagtggaactggcgcagcgatatccactcaagcaaagacggcacgcttctggaacacaccataacggtgacattacccagcggtcagacaacctcgcttacgcgctatcaaagcatcaataataaatccgggcaggcacaagatgattaatcgccagcagggtttcacattgctggaagtcatggcggcgctggcgattttctcaatgcttagcgtgctggcgtttatgattttttctcaagcttccgagttgcatcaacgttcacagaaagaaatccagcagttcaatcagctacagcgcaccatcaccattcttgataacgatctcctgcaactggtcgcccggcggaatcggagtacggataaaatcatggtgttgggtgaagaagcgatttttaccacgcaaagtcgcgatccgctggcccctctcagtgaagcacaaaccttactcactgttcactggtatctgcgaaatcatacgctctaccgtgctgttcgtacttctgtggatggcaggaaggatcaacccgcccaggcgatgctggaacatgtcgagagctttcttctggaaagtaacagcggagaaagccaggagcttcctctctcagtcacgttacatctgaagactcagcaatatggggcgttacagcgccgttttgcattacctgagcagttagcgagagaagagtcgccagctcagacgcaggccgggaataataaccatgaataatgaacaacgcggcgtagcactgctcattgtactcatgttactggcgctcatggctgctctggctgcagacatgacgatcagttttcacggccagcttcatcgaacccgccaggtaaaccatcatttgcaacggcaatatgatattgagctggcggagaaacttgcgcttgccagcctcacccaggacgttaaagataacgacagacaaaccacgttgcagcagtactgggcacaaccgcaacagttgcagctggaaaatggcaatacagtgaagtggcagttacgcgatgcccagcactgttttaatctcaatgccttagcaaaaatatctgacgccccgctggcttcccctgatttccccgcccaggtattcagtgccctgctgattaacgccggtatcgatcgcggaaacaccgatgagatcgtgcaatcaatcgctgactatattgatgccgatgattcgccacgctttcacggcgcagaagataacttttaccaaagccaaacgccgcctcgccatagcgccaatcaaatgctttttctgaccggtgaattgcgtcagataaaaggcataaccgaaaacatctatcagcggcttatcccgtatgtctgcgttctcccgacctcggaacttagcatcaatcttaatatgctaacggagaacgatattccgctcttcagagcattattcctcaataacatcacggatgctgacgctcgggtcttattacaaaaaaggcccagggaaggctggctcaccacagatgcatttctttactgggcgcagcaggatttctccggcgtgaagcccctggttgctcaggtgaaagggcatctctttccctatagccgctattttacgctgagtacggaaagtatcagcgacgaacaatcccagggatggcaaagccatatttttttcaaccgtaaacagcagagcgcccaaatctatcggcgtacgctgcaactctactaatcataaggatcgtgatgcctgaatcgttgatggtaatacgttctttctcgacgctgcgtaagcattgggaatggatgacgttctccgcagatagcgtatcttcggtacatacgctcacagacgatcttccgctggagtcgctggccgatcagcccggtgccggaaatgttcaccttttgatcccacctgagggtcttttatatcgttccctcacgctgcccaacgccaaatacaaactcaccgcgcaaacattacagtggttggcggaggagacattacccgacgccagccaaaattggcactggatggttgtcgataaacaaaacgaaagtgtcgaggtgataggcattcagtcggagaaactcagtcgttatcttgagcgtttacatactgccggactcaacgtgacgcgggttttgccagatggctgctatcttccctgggaagtagatagctggactctggttaaccagcaaacaagctggcttattcgcagtgccgcacatgccttcaacgaactggatgaacactggttacagcatcttgctaaccagtttccgccagagaatatgcgttgttatggtgtagcgcctcacggcgttgcagcggccaatccacttatccagcatcctgaaataccatcactgagtttgtattctgccgatattgcattccagcgctatgacatgctgcatggtgtttttcgtaaacagaaaactgtaagcaaatcgggaaaatggctcgcccgcctggcagtaagctgtctcgttctcgccattctttcttttgttggcagccggggcatcgcgttctggcaaacgcttaagattgaagatcaacttcagcaacaacagcaagaaacctggcaacgttatttcccgcagatcaaacacacccacaactttcgtttttactttaagcagcaactcgctcagcaatatcctgaagctgtaccgttgctctatcatttacaaacacttctgcttgaacaccctgaactgcagttaatggaggcgaactatagccagaggcaaaagtcgctgaccttaaaaatgagtgctaagagtgaagccaatatcgatcgtttctgtgagttaacacagtcctggcttccgatggaaaaaacagaaaaagatccggtcagtggtgtatggacagtaaggaactcagggaaatgattaaatcatggtgggcagaaaaatccacatcggaaaaacagatcgttgcggcattggcggttctctcgctcggcgttttttgttggcttgcggtgataaaaccgatagatacctacattgaagagcatcagtcccacgcgcaaaaaattaagaaggacatcaaatggatgcaggatcaagcgagcacccatggtttactcggtcatccagcgcttacgcagcccatcaaaaatatccttctcgaagaagcaaaacgtgagaatttgactatcacgctggaaaacggtccggacaatactctgacaattaaccctgtcacagctcccctcgaaaacgtctcccgctggctcactacggcacagataacatacggtattgttattgaagaccttcagtttactcttgccggaaacgaagagatcaccctcaagcatttgtccttcagggagcaacaataatgacaatgctactgccgctcttcattctggttggttttattgcaggttattttgttaatgtcatggcctatcacctctcgcctttggaggataaaacggcgttaacgtttcgccaggtattggttcatttctggcaaaaaaaatatgcctggcatgatacagtgcccctgatactttgcgttgctgctgctatcgcctgcgccctggcacctttcacgcccattgtgactggcgcactctttctctatttctgtttcgcactcacgctcagtgttattgattttcgcactcagctcctgcccgacaaactcaccttaccgctgctctggcttggcttggtatttaatgcgcagtctggattaattgatttacatgatgcggtttatggcgcggtcgctggctatggggtgctgtggtgtgtttactggggcgtctggttagtttgtcacaaagagggattgggctacggtgatttcaagctactggccgctgcaggcgcgtggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctgggatatctggcctggatctcttattaaccgggagggttctccctcccgacacggctcaaccttcttcgcgaatctgtgcttgcagataattttgcagtcccatcttctgaatcagatcaagttccgtttccagccagtcgatatggccttcttcatcgcgcaaaatttctatcatcatatcgcggctgacgtaatcatgaacgctatcggcataaccaattgcctcacgcaaattcttcgcgccatccagctcaagtgccagatcagaacgcagcatttcctcaacatcttcaccaatgttcagtttgcccaggtcctgtaagtttggaagaccttccagaaaaagaatgcgctcaatataacgatcggcgtgtttcatctcatcaatggattcatgatactccacatcattgagacgtttgagaccccagtttttaaacatccgggcatgaagaaagtactgattgattgcgacaagctcatttcccaacagtttgttgagataatttataactttagtatcacctttcattttttgactccttcgcttccactctttgaagcgtagaacggcttacgagtaagtcaaaaaacacactccgtttatgcggactccttaaactccggcagttgcattaattcatcctccatcacttcacgcgcggcccggacacatttaccgcactgattgccgaccggaatgaatttttttaattgctggaacgagtggggggaaaactgacgcacagcctgacgaatttttttatcgctgataccattacaaagacaaacgtacatagagactcccgtatacttttttcaaaaataaatgaaaatagttcttatttcaattacggaaagactcttttttaagcaaagaatagaaatatgaataaaaataatgggctaccaaaagtagcccattgacaaaaaatgcggcgataccggaaggtatcgccaacacatttattgcttagtaaacggcgcgaagatttcgctaaatgcgtacttcggtgcctgttctttagtcaggccgtggaattccggagacaggttagtgccgcctggcaggtcgcgcgcgattgaccagataccaaccataccgagattacgcttctgcgcatcctgcatgaccagacgagcatcagagagatagaacacctcgccctgaacgtcgttcacgccaaccatcggcgtggtacccatcatagcgtcaatttctgcatcgctcttgttgggatggaggcctttcaattgtgaatgcaggttggcaatcgcagacgttgcacacttaccgtgaatgttctggccttcggtatttgcagactgacaaatcgcgttaccgtagtccattgtcatcacgttcacacccgccagctcaacacctttcgctttggcatcgctcaggacattcatcccttccggcgtcaggcctgtcggcagaattggcaaggtataccagatagcaatatctttgccttctgacttccatttatcctgcactttcttcacagcaaggttacgacgttcaatagatgcctgatccgcaacccaggtgccttcgatatcgaagtccaggactctgaggttcaggttatcaacgatgtcataataatgctgcattagatcgtcaacgttcttacaggaagctgccagcggggcattattagcaccaccgatagacagcatcacatcaccgccagcctcacgcagagctttgattttgctgtactgagcgtaattctgcataccgtaagcggtaccccatgtcggtagacaggtgttcgcatctttactcaccacaaacgccagcgtgaagtggttgacgttatgactcttagccagcgcagccaaatccgggatcgtattcagcgtaaagtcgacatacggtgcataaacgtgtttcggccacgctttcttcggcgtacctacgcgctctttggttccggtccagtcaacaaaaacacgccacgggttgctgtcagaaggagaaactttctgcactttactctgagaaatgtagttctcaccgttaaagcgaatcagcgtatcactggcataaagcgtttctggattaaactgcggcgcattattcagctcttcgttgctatagctctgagtcttacctaacggcttccacgggcgactattgctaccggtggcgttttggttcgcaatcagagcagggttgtcactttgcgtccagaacagcgcttcataagcctgcccatcaacaacaacgcgatcacctttcacgtacacggtggaagcggaccatgctttcgccggttcgtatttcttccacgggttatcgccgccggggacaaagccccatgcgtcttgatcgacagaggttttataatgtgcatcgttataatctacgatgctgttcgcgctgtacgctttgctggcctggaaaccatccgcaataatgacgccgccattatcaatttcacaggtagtcgggttaccgtactgactcatttccgcagcggtagctgtacgcacgaggcgccatgggttattggagttttctacactggtgccacgcgggcaatcttcagaaccaacccaccaggcattctgataaacattaccattgaagataacatggtaaatttcgctgccttcctggccactccacgcctgcagtgagtaatcgttactgctatccgctggtgttgatggctcgttgttatccggagttggagtaactggagtttccggtgtttccggagttggatcaaccggagtcacagcaccgccattattatccggcttaacggaacaggaggctgggttaccatactgagtgatttctgttgccgttgccgcgcgaacataacgccatgggttgctggcatcgttttctttcgcatcgcctgggcaatttgccgcgcccacccaccaggcgttcttataaatgccgccgttgtagataacgtaccatgtagaagaaccttcctgacctttccaggctacgacagcatagttgtcgtttgacttatcagctggggctggctgaacatcaggagccggtttaacgtccggtgccggtttcacatccggtgcaggctgtggtgctgaagtacaagactgtggattactggtttctgagatttccgttgccgtagcggcacgaacataacgccatgggttgctggcatcattgcctttcgcatcacccgggcagttagaagaggctacccaccaagcatttttatataccgcaccattaaagacgacataccaggtttgaccgccctgctgtttattccaggcaactacagaagaattagacggaacagtgccctgtgctggtgtagccgaagcgccattagcgggcgtattagatgctggcgtatttgaagttgaagaagatgagcttccgctcttttcgcaggaaagtgtattgccaaactgactaatttcagcagctgttgcggtacgctttaaacgccacgggttagttgcatcatttgctttcgcttttcccgggcaatttgtagaagaaacccaccaggcattttcataaattttgccatcgaaaataacctgatatttattaccaccttgttggttattccatgcttccattgccaatgctggcagagcggaacacaccagccccataccaatcatagatttagtaaatatatttaatttcattataatcccttgtaacgtaaaaactgcaaaacaaaagtcctacgcaggaattatttacgttttacgagaacccttcaatatgaattaaagtgcggcatgaaaaataagaaaaaagcctgacaaatgaagcattttaaaaacagaaacattcatatttaaaatattaaattgaattgatattttaaatatgaataatttattcgttctgacagtacgaataagatatgcagtcaacaaatgcaaaaagggcgccgaagcgcccttttcaattcaaaactaattaacgtgtaattagcccagaactttagcaacaacgcccgcgccaacggtacggccgccttcacggattgcgaaacgcagaccatcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacgaccgccttcatctttggacagaatgtacacttcagattcgaacttggtgtgcggcttgatggtgcccggcttagccagtacctgaccacgttcgatttcttcacgtttgataccgcgcagcagaacacctacgttctcaccagcacggccttcgtccagcagtttgcggaacatttcaacgccagtacaggtagacttctgagtctctttgataccaacgatttcaacttcttcaccaactttgatgataccgcgttctacacgaccggtaacaacggtaccacgaccggagatggagaatacgtcttcgatcggcagcaggaacggcttgtcaatcgcacgctctggttccggaatgtaggaatccaggaagccagccagttccaggattttcgcttcccactctgcgtcgccttccagcgctttcagagcagaaccacgaacgatcggagtgtcgtcgcccgggaagtcgtactgagacagaagttcacgaacttccatttcaaccagttccagcagctcttcgtcatcaaccatgtcgcatttgttcaggaacacgatgatgtacggaacgcctacctgacgacccagcaggatgtgctcacgagtctgcggcatcgggccgtcagtcgcagcaactaccaggatcgcgccgtccatctgagcagcaccggtgatcatgtttttaacatagtcggcgtgccccgggcagtctacgtgcgcgtagtgacgggtcggggtgtcgtattcaacgtgagaagtgttgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcgcgacctttggtcagagaacgcagctgagttgcatatccgaacatttcagacagcggtacttcagcgtggatcttaacgccagtaacttcagattcctgacctttgagcataccacgacgacggctcaagtcaccgataacgtcaccggtgttctcttcaggagtttctacttcaaccttcatgatcggctcaagcagaactggtttagctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcgatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgattgcagctgcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtacacacggaagaaggtcaggttaccaacaaacgggtcggtagcgattttgaacgccagtgcagagaacggctcgtcatcacttgcgtgacgctcagccggagtgtctttaccgtcgtccaggataccgttgatcgcaggtacgtcaaccggggatggcaggtaatcaattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatacgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggattaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccaccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggagtgcttaaccgtaagtctgacgaaatcagtatagtcaatgggaatgatgtcgttcgaaattcgaccagtcaaaccgcgggcaataaggtcttcgttcagagcatagaccttaatgggggcattacgcagactttcaaggtagcggttgccgtcaactgcggcagttacgccatcttgcaataatagcagttcgtcaccttcactgagcagacgcagcagcgcagcaaagtccgtcagccagggtgaacgatgtaatgtgtgcagcataacgcctcaaaacctcaaaataacatcgtagttggcgagttcgcggcgtaaggcatctgcttcgagcggcgtggcttcgaccacaaaaggtgtctgcggatctaacccgcgttcgcgcagtgaagccgcacaaacccagcactgttcaatgtcatacagacccaacaatttaaaagtggcaatgtaatcacgcgccagcactgcatcgggcttttgtcctggcagcagctgaaaaacgccatcagcaataaagaagacggccagatcgtcagttaatgcggaagttgcgagtaaagcatctaatccctcgcggccagccgcggtgccatgaggcacagtagaaaaaacaaacgcaattcgtttcatcagaactgtaccaccctgtcacaggtcagcgaggcttccgccagcgcgccaagtccgcttaaggtaaatcccgtctgaaggtttgacgaagccagccccagtcttccggcttccgtttcatcaacaacgccacggcgtaatgccgccgctacgcagatattcagcgccacaccatgttgcatattcaactgttgccagctgcgcacaaggtcaaattcgtcgcttgccggtgaggtcaattggttagcgttatagaccccttcccgatagaaaaaaacgctgcttaactcatggccttctgctattagcgcctgcgcaaactgaaaagcactactcgcctgttgcgtaccgtatgctggcccggtcaccacgatggcaaaacgcattacttatcttgcccctggaaatcaccgctcttgaactggcggatgtagagatagacagtgtgtttggagatgttcaggcggtcagcaacctggttgatcgcgtctttaatatcgaagatccctttctcgtagagatttagcacgatctgacgatttttggcgttattagaaacattgcgatcggcattcacttcttcgatggtaaactccagcgtttgggtaaccagatcttcaacagaagaggcaaagttgacgcttgaaccgacatccggagtttccggcggcacaaaagtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggcctgtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcaaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcggttcttagtgcttattttttagcagagtctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagagagcggttcaccacgggtgtaagagttgtcgaactctttaccgtcgatcagcgtacctttgtagttcactacaacagtatcgctgtctttcggggcttcgcctttaccggcttctactacctgataaaccagaccagtggaagaggttttcacacctttctctttggcaaatttctcgcggtactctttaccttttgcttcgttatcagccgcgtctttttccatcttcgcctgagcagaagacttcacacgagcttcgaatgcttgcagagtctgttcgatctcttggtcggaaagtttgctcttatcagcaaatgcatcctgaacaccagcgatcagctgatctttatccagtttgatgcccagtttttcttgttctttaagagagttttccatgtaacgacccagcgaagcacccagtgcataagctgatttctgatcgtcatttttgaacgctgctttgctgtcagcagttgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgcctccgccacattattaaggcgtaaaaaaagcggggattccccgcttttttgtcaccttttcggtattagtggcaaccgcaaccgccgttgcctttaccgccacagcagccttcgccaccgtgttcatgaccgtgatcgtggccatgaccaccgcagcaaccgtcgtggtcgtgatcgtggtggtgatcgtgcgcgccgtgaacgtgaccatgagccagttcttcttcggtcgcttcgcgaatcgccacaacttcaacgttgaatttcaggttctgaccagccagcatgtggttaccatcaaccactacgtgatcgtcttcaaccgcagtgatttcaaccggtaccggaccctggtcggtttcagccaggaaacgcatacctacctgcagttcatcaacgcccataaatacgtctttaggaacgcgctgcaccaggttttcgtcgtactgaccgtaagcgtcgttcgcgccaacagcgacatcaaatttgtcgccaacttcatgaccttccagcgctgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcggacgtgatcgcgggcttctttgtctgcttctcgcatctgatgtccacacttaacacattctacgatatcaatattattttcgcgccacatcgccattgaatcctgtgcctgacaggccgggcattttgcgcccgcaataaaacgttttcggattgccatctttaccctctactcaaattcatcccagccgtccagctggcgtcgttcttgttgcatttcacgctggaaaatctcttccagttcacgtcgggcttccctggcgcgagaaatttgtacggtatcagcatgcatcgggattaactcccgcagcattcgcatatccaggcggcgaaaatgcagttgcgcgcgctgcgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgctggcatatttccaccagcttcatagtgtcttccggctcgttacaggtaatgacgatagactcagcggcctctgcacccgcagaacgtaaaagatctacctgcgtggcgtcgccgtaataaactttgtagccatatttgcgcatcaggttaacggcactgatatcccgctccagtacagtaatgcgcattttatttgccatcagcaaacgaccaatcacctgaccaaaacgcccaaagcccacgacaatgacctgcggtttatcatcgttgacccatggtttttcgtcttcttcttccggtccgttaaactggcgggatagccatttatcgaccagcttcatcagcagcggcgtggtcatcatggaaagcgtcaccgtcaccagcaacagcgccatctggtcgccctggaataagcgttgtgaagaagcggtagaaaagaggacaaaggcaaactcaccgccctgactcaacacgccagcaaactgcatccgctcagaactgcgcacgccatacaatcgcgccagcagatacagcacgagaattttcaccgccaccagcacaaccacacttatcactacccacaacagatgggtataaagcaccccgaggttgagcgacatgccgacagagataaagaacaaaccaagcagcaagcctttgaagggatcgatagccgtttccagttcatggcgatattcactttccgccagtagcacacccgcaataaacgtaccgagcgccatcgacaaccccagcgcatccataaacaatgcggaacccaacaccagcagcagcgtcgcggcggtgaacacttcccgcacaccagaagctgcaataaaacggaataccggacgcagtaaatagcgcccgccaatcagcatgccgacaaacgccagcaccttcatgccgatcttcatccagtcgaaatgttcgtctgccgaacccgccaacaacggcactaacgccagtgccgggatcaccgccagatcctgaaacagcagtaccgagaaacctaactggccggattcgctgcgattcatccctttctcacgcatcaattgcaacgccattgcagttgaagacatcgcaaggccaatgccaccgaccaccgccgcctgccatgagaaatgggtcagcatcaataatcctgccagcaacgccgcgcttaacagcacctgtgccgcgcctacgccaaaaatcgaacgccgcagttgccaaagcttggagggattcaactcaaggccgatgataaacatcaggaataccacgccgagttccgaaaagtggaggatctcatcgacgtcgctaataaaccccagcccccacgggccaatcgcaatccccgccagcaaatatcccaacactgcaccaatacccagccgcgatgccagcggcaccgcagccaccgccgcgaagagaaacagcactcctgcgagtaaaaaatcagaaccttccatcagcagcctcctggagacagcggatttgccagccagtcaccgtaggctctggcgtggctcgccagctcctgtgcgctttgccgtctcgcccagtaaataatgatggggcttaaccaatgcatccggcacatgcccgccgccagttcaaaggggcgcagaacatcgctcatcggatagcgattcaacgcgtcataacggtaagcactttccggctccccggtggtaatcacgctacgccagtactttcccgccagttggtttccccccggtccgctggcaaaaccacggcttaatacccggtccagccactctttcagtagcgccgggcagctataggtataaagaggatgctgaaagacaatcacctcgtgctcgcgcagtaatgcctgctcacgagggatatcaataaaaaagtcgggatagtgcgcgtaaaggtcgtgcacggtaacattgctgagctgcgtggccggtttaagcagaacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcgccttatgattgttttttcctcgttacaaattcgtcgcggcgtgcgcatcctgctggataatgccaccgccaccatcaaccctgggcagaaagtcggcctggtgggtaaaaacggctgtggtaaatctactctgctggcattgctgaaaaatgaaatcagcgccgacggcggcagctacacctttccggtaagctggcaactggcgtgggtgaatcaggaaacaccggcgttaccgcaagcggcgctggaatatgtcattgacggcgaccgtgaatatcgtcaactggaagcgcagctacacgacgccaacgaacgtaacgacgggcacgccattgcgaccattcatggcaagctggatgctattgacgcatggagtattcgctcccgtgccgccagcctgctgcacggcctcggtttcagcaatgaacaactggagcgcccggtaagtgatttctccggtggctggcgtatgcgtcttaaccttgcccaggcgctgatttgccgttcagacttgctgctgctcgacgaaccgactaaccacctcgatctcgatgccgttatctggctggaaaaatggctgaagagctatcagggcacgctgatcctgatctctcacgatcgcgatttcctcgatccgatcgttgataaaattattcatatcgaacaacaaagcatgttcgagtacaccggcaactacagttcgtttgaagtacagcgcgccacccgtctggcgcagcaacaagcgatgtatgaaagccagcaggaacgcgtagcgcatctgcaaagttatatcgaccgtttccgtgccaaagccaccaaagcgaagcaggcccagagccgcattaagatgcttgagcgtatggagctgattgcccccgcgcacgtcgacaacccgttccgctttagcttccgcgcgccggaaagcctgccaaatccgttactgaagatggcaaaagtcagcgcaggctatggcgatcgcattattctcgactcgattaaactgaatctggtccccggctcgcgcattggtctgctaggccgcaacggcgcgggtaaatcgacattaatcaaactgttagccggcgaacttgcgccagtcagcggtgaaattggtctggcgaaagggatcaagctcggctacttcgcccagcatcaactggaatacctgcgcgccgacgaatcgcctattcaacatctggcacgtttagcgccgcaggagctggagcaaaaactgcgtgactacctcggcggctttggtttccagggcgataaagtaaccgaagaaacgcgccgcttctccggtggggaaaaagcccgcctggtgctggcattaattgtctggcagcgtccgaatctgctgctgctcgacgaaccgaccaaccaccttgacctcgacatgcgtcaggcactcaccgaagcattaatcgagttcgaaggcgcgctggttgtcgtctcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccagaccgacgaagcgccaaaagagaacgcgaacagcgcccaggcacgtaaagatcagaagcgtcgggaagcggagctgcgtgcgcaaacccagccactgcgtaaagagattgcccgtctggaaaaagagatggagaagctgaacgcgcaactggcgcaggcggaagagaaactcggcgacagcgaactgtacgatcaaagccgtaaagcggagttgaccgcctgcctgcaacagcaagccagcgccaaatccggcctggaagagtgcgaaatggcatggctggaagcccaggagcagcttgagcagatgctgctggaaggccaaagcaactgatggcgcagataacaacgaccgatgccaatgaatttagcagcagtgctaaattcacccctatgcgcggctttagcaattgtcatctacaaaccatgctgccgcgtctgttccgtcgcaaggtgaaattcaccccgtactggcagcggctggagttgcccgacggcgattttgtcgatctcgcgtggagtgaagatcctgcacaggcgcggcataaaccgcgtttagtggtatttcacgggctggaaggcagtctcaatagcccttacgctcacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgagtttggtcatgcgccaacggctgccgtcggctattcgctcggcggtaatatgctggcctgtttgctggcaaaagaaggcaatgatctcccgattgatgcggcagtgattgtctctgcgccgtttatgctggaggcctgtagttaccatatggaaaagggcttttcccgcatttatcagcgttacttgctgaacctgttaaaagccaatgccgcgcgcaagctggcagcctaccccggaacactgccgattaatctcacgcagttaaaatcggtacgtcgcatccgtgaatttgacgatctcatcaccgccagaattcacggctacgctgacgctatcgactattatcgtcagtgtagcgccatgccgatgctcaatcggatagccaaaccgacactgattattcacgccaaagacgatccgtttatggatcatcaggtgatcccgaaaccggaaagtctccccccgcaggtggagtatcagctgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtctccgacgtcaaacgccagctacagtgcggagaagcggtgctggtatggtcggagctgcacgaaacggtcaatatcatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagccgaggtggaaggcgacagttttcaccgttatacccgcccggaaatggacatggcgatccgcaaagcgcgcgacgccgggcggcatatcagctacttcggccccgaagcgaacgacttcggccttctggaacaaaccttcattgaatacggtcagagtggcaaagggaaatctcgcaaatatctgcatacctacgatgaagccgtaccgtggaatcaggtaccggggacattcaccccctggcaatctttaccggaacccactgatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcggtagtgcgttcaatggaagactatatcaactacatcacaccgcagttttcccgcacccatcttaacttccagcgcgttcccaccgtcgacacctcaaacccgttcgcggcaaaaggtatcccgtcgctggatgaaagctttgtggtgatccattttcgtaatctggaagggatcgatttcccctggctgctggcgatgttgcaaggctcattcatttcccacatcaatacgttagtggtgcctggcggcaaaatgggtctggcaatggaattaattatgctgccgctggtgcaacgattgatggaaggaaagaaaatcgagtaacgctgctattacgccggataaaatactatccggcttcacaacgggatagttaaatcacgcggcaaccacttcatacgagtgagtaatattcaccgctttttccagcatcagcgccactgaacaatatttctcggcagaaagatcaactgcacgcgcaaccgctgcgtctttcaggtcgcgaccggtgacgataaaatgcagattaatgtgcgtaaacaggcgtggtgcctcttcgcggcgctcagaggtcaattttacttcacaatcgaccacatcctgacgccctttttgcaggatagaaaccacatcgatggcactgcaaccacccgctgccatcaacaccatttccatcgggcttggtgctttatcgcctgagttgccgtccattaaaatctggtgaccagaggcggattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatatattgatgtactgcatgtatgcaaaggacgccacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtctgtctgcacagatggcgcgtcgtctgcaagtcacttcagagaaagtgggcaacctggcgttcctcgacgtgacgggccgcattgcacagactctgctgaatctggcaaaacaaccggatgctatgactcacccggacggtatgcaaatcaaaattacccgtcaggaaatcggtcagattgtcggctgttctcgtgaaaccgtgggacgcattctgaagatgctggaagatcagaacctgatctccgcacacggtaaaaccatcgtcgtttacggcactcgttaatcccgtcagagtggcgcgttacctggtagcgcgccattttgtttcccccgatgtggcgcagactgatttatcaccccgatatcaactatgcacttcgacaaacgctggtgctatgtttgcccgtggccgttgggttaatgcttggcgaattacgattcggcctgctcttctccctcgttcctgcctgttgcaatattgcgggccttgatacgcctcataaacgttttttcaaacgcttaatcattggtgcgtcgctgtttgccacctgtagcttgctgacacaggtgctactggcaaaagatgttcccctgccctttttgctgaccggattaacgctggtacttggcgtcactgctgaactggggccattgcacgcaaaattgcttcccgcatcgctgctcgctgccatttttaccctcagtctggcgggatacatgccggtctgggaaccgttgctcatctatgcgctgggcactttgtggtacggattgtttaactggttttggttctggatctggcgcgaacaaccgctacgcgagtcactaagtctgctgtaccgtgaactggcagattactgtgaagccaaatacagcctgcttacccagcacaccgaccctgataaagcgctgccgccgctgctggtgcgccagcaaaaagcggtcgatctaattacccagtgctatcagcaaatgcatatgctttccgcgcaaaataataccgattacaagcggatgctgcgtattttccaggaggcgctggatttgcaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccaacgcgttttacgatggaaaagcaaattggcgcactggaaaaaatcgcccgccaacacccggataatccggttgggcaattctgctactggcatttcagccgcattgctcgtgtgctgcgcacccaaaaaccgctctatgcccgtgacttactggccgataaacagcggcgaatgccattacttccggcgctgaaaagttatctgtcactaaagtctccagcgctacgcaatgccggacgactcagtgtgatgttaagcgttgccagcctgatgggcaccgcgcttcatctgccgaagtcgtactggatcctgatgacagtattgctggtgacgcaaaatggctatggcgcaacccgtctgaggattgtaaatcgctccgtgggaaccgtggtcgggttaatcattgcaggcgtgacgctacactttaaaattcccgaaggttacaccctgaccttgatgctgattaccaccctcgccagctacctgatattgcgcaaaaactacggctgggcgacggtcggttttactattaccgcagtgtataccctgcaactgttgtggctgaacggtgagcagtacatccttccgcgtcttatcgataccattattggttgtttaattgctttcggcggtactgtctggctgtggccgcagtggcagagcgggttattgcgtaagaacgcccatgacgctttagaagcctatcaggacgcgattcgcttgattctgagcgaggacccgcaacctacgccactggcctggcagcgaatgcgggtgaatcaggcgcataacactctgtataactcattgaatcaggcgatgcaggaaccggcgtttaacagccattatctggcagatatgaaactgtgggtaacgcacagccagttcattgttgagcatattaatgccatgaccacgctggcgcgggaacaccgggcattgccaccggaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacaacgggttattggtcatctgaacaccatgcacaccatttcgtcgatggcatggcggcagcgaccgcatcacgggatttggctgagtcgcaagttgcgggattcgaaggcgtaatacaggctaaaccatcggatgaggtgttcacgccgcatccgacatcttttgcctgatgcgtcttatttacgccccaatcaccttcgccaccgcgtgggcgaaacgatgcatcccttcatcgatatccgcatcttccaccaccagcgacggcgcaaaacgcatcacatcaggcccggcattcagcaccattacgccttcctctgcaccggcatacaggaaatcacgcgcccgacctttgtactgtggtttcagctctgcgccaatcaacagccccataccgcgaatatcgctaaacacatcgtactgctgatcgatcttctgcaaatggtcaacaaaacgctggcgtttcgcctgaataccttccagcacttcaggggtattgatgatatcaaacgccgcgcccgctactgcacaggccagaggattaccgccgtaggtggaaccgtgagaaccaggatgaaacgcggaagcaatctccgccgtggtcagcatggcgctaaccgggaagccgccacctagcgctttcgcagaggtcagaatatccggcgtcacgccgtagtgcatataagcaaacagatcgccggtccgccccatcccgcactgcacttcatcaaacaccaataatgcctgatgctgatcacacagctcgcgcaagccctgcaaaaactctggcgtcgctgccgtcacgccgccctcgccctgaatcggctcaaccaccaccgcacaggtatggtcatccatcacggcttttactgcgtgaagatcgttaaaaggcacgtggatgatgtctgccggttttggcccaaagccgtcggaatattttggctgcccacccaccgaaacggtaaacagcgagcgaccatgaaaagcgttatggaaggcaataattttggttttgaacgggctatgacgcacacaggcgtaatggcgtgccagtttaaaggcggtttcgttagcttccgtgccggagttcataaacaccacgcgttcggcaaacgttgcctcaatcagtttacggccaagacgcagcgccggctcattggtgaaaacgttactaatatgccacagagtttcgccctgggtttttaacgcgttcaccagcgcaggatggcaatggcccaacgccgtaactgcaatgccacccgcgaaatcgacatactccttgccctgttgatcccagattcggctgccctgaccttttaccggaataaactctgccggagcataaatcggcagaatcacttcatcgaaagtcgcgcgtgtaattgctgtttgttcaattgccatctcatgatcaccctgttacgcataaataaatatgaaattataatcacaaaatatgcataaaaaatcactgaatggcaatcagaaatcagcgatgcagaaaattagccagcagttgatgtccttgttcgctaagaatactttctggatggaattgcacaccttccagatcccactggcgatggcgaatccccataatctcgcgggtttcgctccaggccgtcacttcaaagcactccggtaatgagtcaggttccaccaccagcgaatggtagcgtgtcacggtgagtggatttgccagccccttaaatacgcccacaccattatgtgtaatcggcgaggttttgccgtgcatgacctttgcggcgcgcacaactttgccgccaaatgcctgcgccattgcctgatgaccgaggcagacgccaagaatcggcaagcgtccggcatagtgacgaataacgtcaagggagatcccggcttcatctggcgtacaggggccgggtgagatgacaattttttgtggtttaagggcgtcgatatccgccaacgtcaacgcatcgttgcgcttaaccaacacatccgcccccagttcacaaaagtactggtagaggttccaggtaaaagaatcgtagttatcaataagcaggatcatggcggctccggtacgaaagaaccgcgctattttactcagattccccggcttcgcttaccactttgctaaatatcatctgcagcgcggtgagatcccccattgccccattctgatttgcctgattccaggcctctttttcgataccctgccagctcagttgatatccggcatgaatcgccagttgctcgaagaagatccgctgtgccaaaccacttcccacccggaagggatgcagcacgttgatttcacaatagtaatgcgccagccgctcgacgaatttatctttctcaaggctagtcagatacttctcttcctccaaatcctgcatcagggcattgccctctttttcgagataggcaaagtggcagaacggcgtatctccctgataaatatcgacttcgcgcagttgccccgcccagtcgaaaatatcctgatacaactggcgatgaagagtacgcaaatgcggtaaaccccgaaccaacgggccaagttcaatggtcgcagcacgcagcgccgtcatttcgtaagcggcctgttccagccgctgctgctggcggatgttcagccggttacgcatgatatcaaggcctggataaagatacggatcgcgcccttcgccgaatttatcgctcatagtgcctcctcagcgcttcaaggcgcgctaaagcctctgcggcagtaagagtgactaaaggcatctcgacgccttcaagacggcgactggcctggaaattacgattacgctgaagctcccagagacgggacttttgcttatcggtgagtttcttcacttgatgcctccctgaacgtgtccatttgccacaagtataagcggcaaatccgggttacgccgggagagcagaagcgcgggcaagattgcccgcgcgagaaatcattacggcaggactttagcggaaaggataactaccggttttgacggcacattctggtacggaccaacgtcatgagtcggcacctgggaaatcttatcggcaacgtccatgcctttcaccactttaccaaataccgcgtaaccgaaatcacgctgaccgtggtcaaggaaggcgttatcggcaacgttgataaagaactggctggtggcgctgtctttgtcagcggtacgcgccatcgcgatggtgccacgcgtgttgcgcaggccgttatctgcttcatttttgattggcgggtttggttttttctgctgcatctgctcggtgaaaccgccgccctgaatcataaagccaggaatgacgcggtgaaaggtcgtgttgttataaaaaccactgttcacataatcgacaaagttttgcacagacactggcgctttttgtttatccagttccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgaggataacttttattccgtgatcaaaatcacctcttaaaatgcaatttagcaaccgattgcaataaaacatttaatcagatcacaaaatcgcctaaaatcgcccgctcgcggcatagcccgctatgccattttatttttgaacgcaggccaatcatgactaacagcaatcgcatcaagctcacatggattagctttctttcctacgcactgaccggtgcgttggttattgtcaccgggatggtgatgggaaatatcgccgattatttcaatctgcctgtttccagcatgagtaacaccttcaccttcctcaatgccggcattttaatctctatcttcctcaacgcctggctgatggaaatcgtcccgttgaaaacgcagttacgttttggctttctcctgatggtgctggcggttgccggtttgatgttcagccacagcctggcgctgttctcggcggcgatgttcattctcggggtggtcagcggcatcaccatgtcgattggtacattcctggtaacacaaatgtatgaaggacgtcagcgcggttcacgcctgttatttaccgactccttcttcagtatggccgggatgattttcccaatgatcgccgcgtttctgctggcacgtagcattgagtggtactgggtttatgcctgcatcgggctggtgtatgtcgctatttttattctgaccttcggctgtgaattcccggcactgggcaaacatgcgccaaaaacagatgctccggtagagaaagaaaagtgggggatcggcgtactgtttctctctgttgcggcgctgtgctacatcctcggtcagttaggttttatctcctgggtgccagaatatgccaaaggcctgggcatgagcctgaatgacgctggcacgctggtaagtaacttctggatgtcgtacatggtcggcatgtgggcgttcagctttattcttcgcttctttgatttgcaacgtatcctgaccgtactggctggtctggctgcgattctgatgtacgtctttaacaccggaacaccggcacatatggcgtggtcaattctcgccctgggcttcttctccagcgcgatctataccaccatcatcaccctgggttcacagcagaccaaagtaccgtcgccaaaactggttaactttgtcctgacctgcgggaccatcggtactatgttgacctttgtggttaccggcccgattgttgaacatagtggtccgcaggcggcgctgctgacggcaaacggtctgtacgctgtcgtctttgtgatgtgcttcctgttaggtttcgtcagccgtcaccgtcagcataacaccctgacctctcattaattgttcatgccgggcggcactatcgtcgtccggccttttcctctcttactctgctacgtacatctatttctataaatccgttcaatttgtctgttttttgcacaaacatgaaatgtcagacaattccgtgacttaagaaaatttatacaaatcagcaatataccccttaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccggacgtaccgttttttatgacaagctgatcatggcgaccggttcctacccgtggatcccgccaattaaaggttctgatactcaggactgctttgtctatcgcaccattgaagacctcaacgccattgaatcctgcgctcgtcgcagcaagcgcggtgccgttgttggtggcggcctgttaggtctggaagctgctggcgcgctgaaaaacttaggcattgaaacccacgttatcgaatttgcccctatgctgatggcggaacagcttgatcagatgggcggcgagcagctgcgtcgcaaaatcgaaagtatgggcgtgcgcgttcacaccagcaaaaacactcttgagattgtgcaggaaggtgttgaagcgcgtaaaaccatgcgttttgccgacggcagcgaactggaagtcgactttatcgtcttctctaccggtatccgtccgcgcgataagctggcaacccagtgtggtctggacgttgctccgcgtgggggtatcgtcataaatgattcctgccagacttccgatccggatatctacgccatcggtgaatgcgcaagctggaacaaccgtgtatttggtctggtagcaccaggctacaaaatggcgcaggtcgccgttgaccatattcttggtagcgaaaacgcctttgaaggtgcagaccttagcgccaagctgaaactgctgggcgtagacgtaggcggtattggtgatgcgcacggtcgcacgcctggcgcacgtagctacgtttacctcgacgaaagcaaagagatctacaaacgcctgattgtcagcgaagacaacaaaaccctgctcggtgcggtactggtgggcgataccagcgactacggcaacctgctgcaactggtgctgaacgctatcgagctgccggaaaacccggattccctgatcctgccagcgcactcgggtagcggtaagccgtctatcggtgttgataaactgccggacagcgcgcaaatctgctcctgcttcgacgtcaccaaaggcgacctgattgctgctatcaacaaaggctgccacaccgttgcggcgctgaaagccgaaaccaaagccggtacgggctgcggcggttgtattccgctggtcactcaggtactgaacgcggaactggcgaaacagggtatcgaagttaacaacaacctgtgtgaacactttgcttattcgcgtcaggaactgttccatttgatccgcgttgaaggcattaaaaccttcgaagaactgctggcgaaacacggcaaaggttacggttgtgaagtttgtaaaccgaccgtcggttcgctgctggcctcctgctggaacgaatacattctgaagccggaacatactccgctgcaggattctaacgacaacttcctcgcgaacatccagaaagacggcacctactcggtgatcccgcgttctccgggcggtgaaatcaccccggaagggctgatggcagtgggtcgtatcgcgcgtgaatttaatctctacaccaaaatcaccggctctcagcgcctggcgatgtttggcgcacagaaagacgatctgccggagatctggcgtcaactgattgaagccggcttcgaaaccggtcatgcctatgcgaaagcactgcgtatggcgaaaacctgcgtgggaagcacctggtgccgctacggtgttggcgacagcgtcggcctcggcgtggaactggaaaaccgttacaaaggcatccgtacgccgcacaaaatgaagttcggtgtctccggctgtacccgtgaatgttcagaagctcagggtaaagacgtgggtattatcgccaccgaaaaaggctggaacctgtatgtttgcggtaacggcggcatgaaaccgcgtcatgcggatctgctggcagcggatatcgatcgcgaaacgctgattaaatatcttgaccgcttcatgatgttctacatccgtactgccgacaaactgacgcgtaccgcgccgtggttagaaaacctcgaaggtggcatcgattacctgaaagcggtgatcattgacgacaaactggggctgaacgcacatctggaagaagagatggcgcgcctgcgtgaagcggtagtgtgtgagtggactgaaacggtcaataccccgtctgcgcagactcgcttcaaacacttcatcaacagcgataagcgtgacccgaacgtgcagatggtgccagagcgcgaacagcaccgtccggcaacgccgtatgaacgtatcccggtaactctggtggaggacaacgcatgagccagtggaaagacatctgcaaaatcgatgacatcctgcctgaaaccggcgtctgcgcgctgttaggtgacgaacaagtagcaattttccgcccgtatcacagcgatcaggtgtttgcgatcagcaacatcgacccgttcttcgagtccagcgtgctgtcacgcgggttgattgcggaacaccagggcgagctgtgggtcgccagtccgctgaaaaagcagcgttttcgcttaagcgacggcttgtgcatggaagacgaacagttttccgtcaagcattacgacgcgcgagtgaaagacggcgtggtacagctgcgcggttaatattttaacgggaggcgcaatgcctcccctttttgcatggtcctgtaataaccttcggtatattgcaggacattttttaaactttttgttttattttttgtttttattttttaaaggataatcaaatgtttacagacactattactaagtgtgcggctaacgctgcgcgcattgcacgcctgtcggcaaataacccgctcggcttttgggtcagctccgccatggcgggcgcgtatgtgggtcttgggatcatcctgattttcacgctcggtaatttgctcgacccgtccgtacgtcctctggtgatgggcgcgacctttggtatcgccttaacgctggtcattattgctggttctgaactgttcaccggacacaccatgttcctcacctttggggtgaaagcgggcactatcagccacgggcaaatgtgggcaatcctgccgcaaacctggctgggtaacctggtcggttccgtcttcgttgccatgctttatagctggggcggcggtagcctgctgccggtcgataccagcatcgttcactccgttgcgctggctaaaaccactgcaccggcaatggtactgttcttcaaaggtgcattgtgtaactggctggtttgcctggctatctggatggcattgcgtacagaaggggcggcgaaatttatcgctatctggtggtgtctgctggcatttatcgcgtccggctacgagcactccatcgctaacatgacgctgttcgccctctcctggttcggcaaccacagcgaagcctacacgctggcgggtattggtcataacctgctgtgggtgacgctgggtaatactttatcaggtgccgtattcatgggattgggttattggtatgctacgccgaaagcgaatcgtccggttgcggacaaatttaatcaaactgaaacggctgccggttaattactaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacagatgatgacgcgcttaaccagcgcgtcagcgaagccgctgaatctcgtcgtatcttctgtaacgtggtcgatgcgccgaaagccgccagctttattatgccgtcgattattgaccgctcaccgctcatggtagcggtatcctctggcggtacttctccggttctggcgcgcctgttgcgcgaaaaactcgaatcactgctgccgttacatctgggccaggtagcgaaatacgccgggcaattacgcgggcgagtaaaacagcagttcgccacgatgggtgagcgtcgccgtttctgggagaaattgttcgttaacgaccgcctggcgcagtcgctggccaacaacgatcagaaagccattactgaaaccaccgaacagttaatcaatgaaccgctcgaccatcgcggtgaagtggtgctggttggtgcaggtccgggcgatgccgggctgctgacactgaaaggtctgcaacaaattcagcaggcagatgtggtggtctacgaccgtctggtttctgacgatattatgaatctgatacgccgcgatgctgatcgcgttttcgtcggcaaacgcgcgggataccactgcgtaccgcaggaagagattaaccagatcttgctgcgggaagcgcaaaaaggtaaacgcgtggtgcgtctgaaaggcggcgatccgtttattttcgggcgtggcggagaagagctggaaacactgtgcaacgcgggtattccgttctcggtggttccgggtattaccgcagcttctggttgctctgcctattcgggtattccgctcacgcatcgcgattatgcccagagcgtacgcttaattaccggacacttaaaaaccggtggcgagctggactgggaaaacctggcggcagaaaaacagacgctggtgttctatatggggctgaatcaggctgcaactattcagcaaaagctgattgaatacggtatgcctggtgaaatgccggtggcaattgtcgaaaacggaacggcagtcacgcagcgcgtgattgacggtacgctcacgcagctgggcgaactggcgcagcaaatgaacagtccatcgctaattattattggtcgggttgttggcctgcgcgataaattgaactggttctctaaccattaatttaaccagggccagagaagtctggcctttttcgtttacaactctctttatatattcagcagataaaaacataaccccttaataaatattgtctgctaatgggttatattcaccgttacagcgacttacaaaattaagtcaatcgcttactgacgctaattgaatattcctgtatcgttcttaatgagcagtctgcttatattcatataatcaatgaatattaattaatatataatacatagggaatgtaaatgaacaaatttattaaagttgcactggtaggcgcagtactggctacgttaactgcatgtactggtcatattgaaaaccgtgataagaactgctcttacgactacctgctgcacccggctatttctatttctaaaatcattggcggttgcggtccgactgcacagtaagtctctgacagaaatcggctaacgccggtttaattgcctgacgccctcggagttatccgagggcgtatttgtttctgcattcttttcaaaaatatcgtttacaacgattaaatgctggcaatactttcacgcaagatccgcaatatcgtctcttcaccgctgcgatttgggttaatgcgaatcgcgcaatgttctaactgcggattcgcctggcgaaacgttccggaaagtcgataaaagagcggcgggatttcatattttgactctgcaccaaccgggtaaggcaaggcaccgagtttctgcgcctcttccagcactctggcggcaatcggctgatgaaactccacaatcaataccttcgactgtgcattggcaatgacggcgcttttcacttccgccaccgcgccgccgttaagcaaagccagcaaccgttcagatacccccgcctgcaccgcgtgcatcactggcgcgagcaccagaccacgcaacacctctaatgcctgcgccccctgaatctgactgccgccggaatagagcgtggcgcgaatccggctaataacatcggcatcgcctaccaccgcaccaacgccctctggcccaaatagcttgaagcaggaaaatgtcgacacattcgccccgcattcgcagccgattcgcgctaccttcatcaccgcatagttgtcatcggttaacgctggaacacctgccgcgcgcaacgttgccagcacgtctgccagcacatagcggtcctgcggctgctggcgcgtatgctgcaccagcgctgcatcaggttgttgctcgtcaacaacctgcttcagtgccgacagatcattgaaatcagccgtaatgagcgttagccccatctgctcaataataacccgtgtcgtcgggtaaacaggcgcgtcatgcaccagaagacgctgccccgatttgagcaaagccgccagtgccgcacggatcgcgccagtacccgcgccctgtaccagcgccgcggcctgtgcgtgaaacgcgtcagccagcacctgttccacacgctgggtaatgcggggctgatttagccccggcgttaagcccaaatcaccgcaggtaagaaactcgcagccaggaaaatgacggcaaatcgtgtccaccagcgcaaactgcttttgctgcgcctcaataagcgtcaggctttgcagaggaaacgtcttcataggtgccttccttaagccggaacgaacaggccaagccagtaaagaacattcagcaggatgccggtgatcattactgctacgaccggtgccgccattttctgtaccggacggcccagggattcgttgaggaagtaaatggcaaccgcgatagagaatccggtatagcccgccattttgattgctgcaaagatcgaaccgaccagcaacgccacttccatcagcatattcatggcgttacggatgttatccgacgcattacgtaccgacgggtagcgccccaaccatttgccgatcgaacgaagcagcaagacttccgccgaaataaccactgcgcctaataccgctgcaaccatcggattcggcgagagatagcccaccgcataaacaaaggtaaagcccgcaactgcatacacaccggtggctaacgccgtggtggcaatcaacggcacaaaacccagcccgcgcataaattctgccagtgccgcctggttgattagtgtttgcgattgttccggcgttacgcctgcggagtacgctttctccagtgtgaagatcgacacttcactaccggcgaaaatcttcatgctggcaacggcagcaatcaatgcacccacgatggcgatatacggtaagtttttgataatccgtgatgtacgctcttcaaacaccgacataccgctggcatcgatatcattttcatcacgatgacgcaggtcatgagttattgcgatccccagcagcatcaccatgccaataaagatttcgatggattcagggttaagatgtggggaatagcgcactaccaccacacgagtcatcagtaccaccacggcggcgatcagactttgcttccagccaaactggtagaaaatcgccaccaacgggaacagtgcaaaagctgaaaccaccggcgagcttaattcccccaggctacctaatacatccaccggtagcgcggtcagcagctggtttactggcaacagacaggtgaggatcaatattccccagatagcaccaagaccaaacgccatcaggctgtttatcgccagtacgccgaggatatcggtaggaagaaagagtaaccatgcgttgagcagcccgtttttcagggtaaaagagatccccaccgaggccacaaaaccaatgctcagaccaaaagcgatactccccgcctcgcgacggttcatatagccttcaatcagttgtggcaggatcgggcggataccgtcatgaaaaacggccgccgagcgatgcgccagaagcgatgtcatacccgtcaggcacgccaccacgataatctgaatatacagatccatagtcgtgccttttatttcagatggttaatcagcatcggaatcgcgtgttcaacgtgctcaacggaaaggccaaacgccacttttccttcagcgatcattttggcgatatgttcgtctttcgctttaatgcccggcttggcaatggtgcaacttttgttatagccaatcaccgcgatagcaatcgacaatgccgcgcccgcaccggtattacacgcaccgatgtagtaatccagttgcccggatttcactttcattgccgcttccatgtcgttgtgaatgaaaacttcaaaacagccaggagccgtcgcttcaatggtttttttaatctgctcacgctgtaagcctgcaacgccaatctttttcatgagtctgtccttattggaaaaattgagagggattttcacgtaacatcacatccacatcggcctgactgaatcctgactggcgcaattgcggaataaaggtggtcaataaaaagtcatagccataaccaccgttggcttttaaatgagagcgccgcgtaatatccatcgacagcatgacgcggttcagcaacccacggtcacgtagcgcatggagcatcgcaatgcgcttttcgtccgggtagtaactgttcttgccgatggtgtcgaactgcacatacgcgccgagatcgatcatcttcaaaatgttgtcgagattgtctttcagatcgcagtggccgacggtgacgcgcgaaagatcaactccgtgggcttgcaacagagccagttgctccagccccatcgtgctgaacgacgtatgcgtggagatcgggcgtccggtctggttatgtgccagcgcggcggcaataaacaccttctcttccagcggcgtaatcttcccttcgctggagccaatctccgcgatgatcccggctttcaggtcagtgccatcgataccctgctcaatttcatcgaccatctcctgcgccagttcctgcacgctgcgggtcgccacatgttccgggaaaaacgcgtcctggtaataaccggtacaggccaccacgttgatcccggtttcgcgcattacatcgagcataaattgcacattgcgccccatgtaacggttggtcatctcaatcacattacgcacgccccgggccatcaggtcgttcatctcctggcaaatgaacgcatactgatcaaggcggcagtccacgttgtttttaaagccggaaagatcaatatgcagatgctcatgggcaagggtgtagcccgtcggatcaaaactcatagggtgtctcctgcaaaccggaaggaggaaagaaaagagcgaccattttgtggcggtggcgcacggaaaaattcacacactgtagcccccacatcagaaagcgtggtgcgcacaccgagctgcgtagcgaccagtccttgctgataaaccagcactggcaccacttcgcgggtatggtggctgtgaccaatggtcggatcgttaccgtgatccgccatcacgaccaggcaatcatctggctgcatcgcctcaacaagccgggcaaggttacggtcaacgacctgcaaacgttcggcataacgtgcgacgtcttctgcatgaccagcgaggtcggtttcctggatattggtacaaataaacgccgtcggataggtgttaaattcgttgagggtgatatccataatccgctggctatccaccaggttttgccagctcacgccataaggattgctgacgatatctgccaccttacccaccagcacggttggcacgcccgcttcatacagtttttgcggcacctgcactttttcatcaacaccgtagcccatatgtacgacctggaaaccgttgtcataggcgccagaacgcggcgcattgatgccaataaagcgcccttctttgctttctgcggcatcgagaatgcgttgactgtcgggtaacaggccgccaaatgtaatgacccgaccgacctgtacctgctcacgcacaatacgacccattttgattgcgtcgtcaaaagagatcacagagagattggcggtgatgttatagacctggcctaaatccgcctcgagattatcgccaatcgcaaccgcctgattgacccacagaaattgcagatcatcgccacgacgctccacctgccaaccggcggatactaatgcctgctcaacacggtcaatcacatcacgaaagggcatccgcagcggcggtaatgggcgcgtacctaaaatctcctgatgccccataaaggtatcgccaccttcatgttgcagttccgccacgccccaggtggaggagtctgacggctgcatatcgccaggcgcataacccaatgcgttgattagccccagcgtctccagcgttggtagctgcaaatgcggcaactggctcaggatgtgaccacaggtattcgccccggcatcctgcggacgcaccaacgtgacatctttcattgcccctacgccaaagctatcaatcactaacaccacaaatcgcgccatttacgcctccagagggttgccgaggctgtcataacgaccaactatttctggttcgccacggtgaataccggacaccagcaccacatcgctacgggtgataaaaatctgcgtgcgaaaacagagcaccactgcactgcttaccggatgctcgcctgccagcggcagggtgtagtcgatactgctgtcatcaacggcgttgagatatgtttcagtaattctttgattttctggcgtaaacaccagcgcatgttgcgcgtgaccacgacggtagtaaccgccgccgtagcagtagctgtcgccacggaaatgatgggagatttcacttaaccagagcatcgcgatacgttcaggctgatcgccctgttgatttgccggaatagtacccgtcagcgcatgaccgggttcggtatgagtcacaccgtattccgccagcaatggcagcgacgtgcagctggtcgctgaaggcgcgttcagttgctcaatcgcaataccagatttcgccagttgatcccgtgcttgtaccagcgtgtgaagattcggtgtcggcaaaactttcccggcagcctcatcccaaagcaggcaagggaaatgggtaagtcccgccaaatgtagccccggcagattctggatttcagcaaccacctcgtgcagcgaatgctgtacaaaaccgctctcctgccccggataaagaaaatcatcgtcgctataaactttgagcagcacagactgcacacgtccggtcttcaccgctgccgcagaaatttcccgcgctttgtcgagggtaaacacagtgatgacgtcggttccctgttcaacggcgtcagaaacctgatgacaagggatttgtaccagatgcccctgatgcgctaccggcaaaccggcgcggcgcatgactcgcacctctttgtaatccaccgccacaatgccgctgtagcccagagccagcagtttttctgccagccacggattacgaccgaattgtttggtcatcagatacagttcaatgccgtaaagccgcgccgtctcaatcagccgcttgccgttttccagaacttgatccacgtcgatcacccaactgtccggggcgatcttgccctgctgccacaaacttagtgcggcggaaatcagcgccggattctggcgtttcaatgcttctacaaacatcttgttgcctcgtttctgttccttgaattaaatattcatttttttgaatatttaggttgtacgacgtggatttatcgggagcttcaaacctcttcgttagcagccatccataatccataaaggttggccagcaaatagccttcttcacacgggttaacttccagtgcaaattccttcaacaatacctgatgcaattgcacaacggcttgccagtggctggattgcgccagttccgccagcaattcgtcatccagcggctctatttcttcaccacggcgactgcgcatcagtgcactcgccatatgtgtcatcgccatcgttccttgctcactgcgcaccggtagatggcactctgtttccagtacattgacgacctgcatcatgcctttgcagatgtccttatcaataacgcctgcatcgcaaagcaggttgagtctggtttccatatcagatgcctttcgtttaataactgggttcctgttccccactgactactcgctgttgatgagcaagcagggcatgtttatcaacaactgcacgcagcagttgttgcattgggtaatcatcggcacgcgtcaggatcacggcttcggtggcctgtaaaaatcgcggatcgtctgtgagcggcgtcgcttctaatcccagcatagtcagttcgttttccgccactacgttccagataaccgcgtcaacatcgcctttaacaatgcgttgtaaactctcgtgataagagagatcgactcgttccacatcactatcgccaaaaaagacatcggtcatgattttctgatctgccgaacggttatccagccccacgcgcttcacgtttgcggactcgcctttacggcaaatcaactggtgctcgccaacgtaggtatgcggtcccaactccagcgcgaggcataatcctttttgcgtgagataactttccgccgccagtcgcgaaaccaccgccatgtcatacacgccgttaagtaaacactccacgcgaatatccgcgccgcgcatatgcgcatagtaaaaaggaatgccatcaaactgggctttcaatccgctcgccaggccttcgtacaaacgggtatagggcaagggcatcgcacataccacgttgttgatatccacatgagtcagcaatgctttgttatccatctcgaccagataactgccattgcgcccacggcgttcaatccgtatcgctccgcttgattccagcgttttcaacgcggcctgcgtcaggccaaccgatgaacggcattcagttgccagctcatctatggttttcagtcgattaccgcacttttcacccaacaaataacgggccagtgtcgtgataacgacgccttcttttttgataaacgttcgacgcataatatattttcaataaaatgaatgtttatatcttcaggaatttgaagataaggcgcaacagcgagatgtggaaacggcgaggcgcttcacattttttcggattattgcaaatgaggataaaaaaaccgggtttccccggtttttggcattaatgttaaattacggcttcgccacaaaaccaatcgcttcgtacaccgcttttagcgtacgggaagcgtgtgcgctggctttttctgcgccgtctttcatcacctgttgcaggaaggcttcatcgttgcggaaacggtggtaacgttcctgcaattcagtcagcataccggaaacggcatcagccacttcacctttcagatgaccatacatcttgccttcgaactgtttttccagttccgggatgctctggcccgttaccgcagaaaggatatccagcaggttggaaacgcccgctttgttctgcacatcgtagcgaactaccggcggctcgtcggagtcagtgaccgcgcgtttgattttcttcactaccgatttcggatcttccagcaggccgataacgttattgcggttatcgtcagacttggacatcttcttggtcggctccagcagcgacattacgcgcgcgccagatttcggaataaacggctctggcaccttaaagatatcgccgtacagcgcgttgaaacgctgggcgatatcgcggctcagttccaggtgctgtttctggtcttcacccaccggcaccagattagtttgatacagcaggatgtccgctgccatcagcaccggatagtcaaacagaccagcgttgatgttctcggcataacgcgcagatttatctttaaactgtgtcatgcggctcagttcgccgaagtaggtatagcagttcaatgcccagcctaactgcgcatgttccggcacgtgggactgaacaaaaatggtgcttttctcaggatcgataccacaagccagatacaacgccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttagagactgataaattacatcaggctggctgagatcgatagcctcgccgtagttatatccgtaggttaagccaactgatgggcaacctgccgcttttgctgcctgaatatcattgcgtgagtcgccgacaaacagcatctgttgtggagcaatgcccatccgttcagccaccagtaacagcgggtccggatgcggttttttgttttgcacatcatcgccgccgataaccacgctgaagtatttggcgatatctaaggcttcgagcagcggcgcgacgaacggcgtcggtttgttggtgaccaggcctagcggcaggcctttagcctgcaacgcgcccaacgtatcggcaacgtgcgggaacaaaaacgtcccctcttcggcaacctcgccatagtagcgatcgaacagtttacgcagaatacgtacctgttcttctgccggaatgtcgtcatcaacgggcggtttacccattgttttacgcagagtcgcacgttcctgacgcgcccaggtcaatgcgcgctccatcagaatattctgcgccgttacccaatccaggtaataacgcgttcttcacctgcgacaggcaactccagcgcatacagcgccatatctaccgcagcagcaagaccgggggcactgtcaaccagcgtaccgtcgagatcaaaagcgacgccgcgaatatcttcaaacttattcatgacttacctttgccagttcactgcgcatttcatcaatgacttttttgtagtctggctggtcgaagattgccgaaccagcaacaaacatatccgcgcccgccgcagcgatttcgccaatgttgttcaccttcacgccaccgtccacttccagtcgaatgtcaaagccagactcgtcgatacgacgacgtacttcgcgcagtttatccagtgtttgaggaatgaaagactgaccgccgaaaccaggattgacggacatcagcaggatcacatccagcttatccatcacgtaatccagataactcagaggtgtcgccgggttaaataccaaacccgctttacagccattttctttaatcagttgcagcgtgcggtcaacatgctcggaggcttctggatgaaaggtaatgatgctggcaccagcggcagcgaaatcaggcacaatgcgatcgacgggtttcaccatcagatgtacgtcgataggggcggtaatgccgtagttacgcaaggatttcagcaccattggcccaatcgtcagattgggaacatagtggttatccatgacgtcaaaatgcacgacatcagcgccagctgccagggcttttgcggtatcttcacccaggcgggcaaaatcagccgacagaattgagggagcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcaccggaatatggcgatcaaccagaccttcagcgatctccgccagatgcgcttgttgttcaagcgtaaaactgtttgtgtgatacgccgtaaagttggcagtcgcagacagcggcgcataaggcggatcgcaatagacgacagatgcatcatctgcgcgcgccatgctatcggcgtaagactcacaatagaaaaaggcattctgcgctttttcagcgaagtgatacaactctgcttccgggaaatagggttttttgtagcggccaaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcggcgcaatttgtttcgggaacaaacagctcgcgtgcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaacgcccgcaatgataaaccattgcgggagataaccttgattacttcagatcggcctgtacctgacgcagcggtttcgcccacgggtttttggcctggacatctgctggcaatgtagataccgcttttttcgcctcttctttcgaagcatacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttccctccagcggctggtgttgccgtggtttgcgccggggatgccgtctgtactggagccgtagtcgccgtctcttttggtgctggcgtagaagtcgcagccggtgcctttgtgctcgccacaggggcagctggttcagttcgcttcggcgtctgtgcgactggcttcggttccgttttcacggttgcttgcggttttttcggttcaatcaccgcctgctgacgagccgggcgcgtagtggccggacgttcagcggtttgcgttttcgccgtgtcacgcgatgcattgccattgcgaacaggcgcaaccgttgcgggttcagtcggcaatgtagaattgaccgccacattgttcaactgttgctgattttgtggctgggtcagcgcattgttcaggtcaccctgcacttcaacacgttgttgaccatccgttgccaccggggtttgcccttgagtcggcgtagaagagatcggcggcagagaaacatcctgctgagtattttccgcagacgtggttcccggcgctggctgcacgccattggcctgatcggtcgcattgcctgcaagatcaatactcttctcgccagacgcggtttgatcgctggaagaggtcgagggggcttttagcgcagaaccgataccgatgatcaacagcagtagaaccagaatgccgacacccatcatcatatactgacgagaagcgggtttactggctgcttttttgcgcttacgcggacgacgctctacgcgctcttcatccacggtttcatcttcggattcgtcaatttcttcttcgatttccggttcctcattacgcgctttttgcgcacgagtcggacggcgatcgtcagtgtcatcaagttcaatatcatcaaaattgatctgcggttcgccacgttcagtacgctcagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgcatctctcccgcaaggactttcttgtcacgcagcatatgcggtaaatacgcctgcgcggacatttcgcgcggcccattgaccggtaacccagcccgcgtgagcagggttataatacgctgcgtttcggcagaactaaactgcccgagacgttccgacgtccgcgccgccatcaccatacccgcagcgaccgcttcaccatgtaaccaattgccataccccatttcagcttcaatggcatgaccaaaggtgtgtcccagattcagtaaagcacgtaacccggtttcgcgctcgtcggcggcgacaacttctgctttcagctcacaacaacggcgaatacagtacgccattgccggaccgtccagacgcaacaacgcatccagattctcttccagccagttaaaaaacgcaccgtcaagaataatgccgtatttgatgacttctgccagccccgacgctaactcacgcgggggaagcgttttcagacagtcgagatccaccaccactgaagcgggctggtagaacgcgccaatcatgtttttaccgaggggatggttgaccgcagttttgccgccaacggaggaatcgacctgcgacagtaacgtcgtcgggacttgaatgaaacgtacaccgcgctgataactcgccgccgcgaagccggtcagatcacccactacgccgccgccaagcgccaccagagtagtatcgcgaccatgcggcttttgtaacaatgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggtttgcaaccactttagcgctttgatcatcagtacgaatggtcacgtcggcaatctcttcatacagcggattgcgttcattggccaacgcttccagaacttcacgcggcggtgtttcaacgtgcagcaacgggcgttttttatcacgctgcgtgcgtgcaagttgcttttcgatggtcgtttcaagataaacgacaacgccacgagcggaaagacggttacgcgtttcacgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtaaaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgtaaaaacattaccgcttttacggctgtttactcactggaaaccagtcgtggcgtgataaacaccactaactcgcgtcgttcatcttcttttccgtcatgacgaaataattgcccgaaccagggaatgtcgccaagcaacggtacgctatcctgacccgatttatttttacgggtaaaaatgccgcccagcgccaacgtttctccgcttttgacctcgacctgcgtttcgatctcctgcttatcaatcgccagcacttcgccatctgcctgctgtagcacctgccccggaacgttctggctgatgtgtaatttcagccggatgcgacctttttgtaacaccgtgggcgtgacttccatccccaggacggcctctttaaattccaccgacgtcgcgccactttccccgctggaaacctgatatggaatttcgctcccctgtttaatgctggcaggctgaagatgtgaggccagcagacgcggactggcgataatatccagctgctgtttttgttcgagcgcggaaagctcaagatccagtaaacgtccgttgatgcgtccaatgttaaaaccgatatgcgttgtcgccgtcgctacggagaggtcgctgccaagcgtggtgacttgcccaacgccaccagcttgttgcgcatcggccagcgtccatttcacacctaactcacgcaaacttttttcattaatggtgacaatatgcgccgagagctcaacctgcccgaccggcagatccatttgcgatacccactgttcaagcgtgcttaacgccgttttgttatctcgcagcaaaaggcgattggtgcgtttatcgacggtcatactccctttggcactcagtagcttctcccccgctttcgccagctctccggcgtcggcgtattgcagagtaatattgcgattttccagcggcagatttgcctgcgcccgcgtctgctccgcctcctggcgggcgatattgtcattctgccaggcaacggaatgcaccgagagaatgttgccctcctggcgcgttatcaatccggcgcttttcactacagtttgtagtgcctgcttccagggaacgtcagttaaatgtaacgacaccgtaccgctgacgtctggcgaaaccaccaggttcaacttctcctgttcagccagcacctgcaacacctgagctaccggaacgtcatccaccatcagcgtcactttttgcggctttgccgcctgtacgccgggtataagcatcaacagtagtgcggctatccattgcttcatttgtatctccttgccgttgccacaaccagtgtggcggttcgcagtttgtcccggttcccagcgttagtgcgtctggcgtcagctgtaagatcgtccagccgttttccagcacatcgttttgctgcacccgtcgccattttttttgcccatcttttattacaccgatgatgcgctcgcctctccctaccatcccctgatagcgccactggctaagttcgctaatccggcatagatcttccggcggtttaaaagggtcacgcataccggttaaaaggcacaatgcaatgcctgccaacaaccagcgtttaaccctcatgcggcgtctccagttgtagcgtgaacaaaaggtcatcaccttccacgcttaacaaaaaacggctcacgctgacgttgcgctctgccagccgtgtaaatgccgacggcactgcttcccacagcgttttcaacgccaactcacctccctgcgcggatggatgccagtaaaccagttgcgcgccggataactgaaaatccagtggcgaaaagggcagcgttttttcttcgctgaaggaagtggtgtctaccaggcgatacagtgcagcccactgctggtgatgatttgcccgtagtcgaattaatgcatcgctctcttcatggtgtgtcaatgacagaaaaatgagcgtaactaacaccagcaaccagactgcccagcaaaactggcggaggcggagtgatgtggcgaaccaccagtcaaagaacatgttcatcgctaaccttccttgttaactgatactcaaattgccagcgtccctgcgcatcctgctgcgtggccccccgctgattgagatgaaaagaagcatcctggcgtagtgacgtttctagtgcgtttaacgcggtaatgcttgttgtcagccccttgatctccagcgttccctgctgccagcttatcgttgtcagccaggcatgttcgggtaaaagcgccgccagtgcttccagcgcagattgccagtcgcgggtaaattgtcgctggcgctgacgttgcaaacgctgttcgcgtaactgctggcgttccagcaaacgtggtttcgttatctgtaagctgcgggcgagttgttgttccgcctgaagcaaaacggcgtttacgcgtgcttcggcattgcttgtcagacgcagtattagcgttatcccgacggccagcagcaaaggcgcaacgaacatcagcaaccagaaacgaagaaaagcggtccggcgttgctgtcgccagggcaaaaaattaattggcgggttcatcagtacaccttcccaagcgccagccccagcgcgatggcaaagtctccacctggtggcggtagcggcggctgacgaacagaaaccgcctcccaggggtcaaatccgccttcgccacatagcgcgacgctttcgggatcaacagataacgctgccgccagctccttcgcgctagtcatccccaccgccagtttgcgcccccagctatagcgcgtcgcccacagccactgttcgttatcacgccaggccagacattgctgatgagaaggtaaaaaaggcaggaatcgctgtaatgcactggcatccggagtgatcgcgctaacatgaacacgcaacctttctgccagagtaagcagcgttgccagctctttgctttgcgcggcagtcacgttataggcgggactgagtgcgtcttcgctgtaatcgaagcgcagggagtccggatccatatccagttcacgggccatcgtcccggacagccaggccatttgctcccgctcaccgagggacatcgacgggcgtggaaatgaccgctgtaatgtgcgactggcgggaaacgccaacataatgtgatgacgctgcggcagttcacgactccacggtaacaacgtgttagccagccgctgcacatcaacaatccgcccatctttgataatgtcgttctccagtggcaaccgccaccagcggtgcaataagcattcttttgcgctccgcacgatagcaaccgctaccgcttcttgctgttgtaaatgcaaaccaatttgccagttcttaaatgccattgtgatgatctccttatcacccgtcactctgacaggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccgccggagatggtgaaagcctttatcgcgacggaagatagccgcttctacgagcatcacggcgttgacccggtggggatcttccgtgcggcaagcgtggcgctgttctccggtcacgcgtcacaaggggcgagtactattacccagcagctggcgagaaacttcttcctcagtccagaacgcacgctgatgcgcaagattaaggaagtcttcctcgcgattcgcattgaacagttgctgacgaaagacgagatcctcgagctttatctgaacaagatttacctcggttaccgcgcctatggtgtcggtgctgcggcacaagtctatttcggtaaaacggtcgaccaactgacgttgaacgaaatggcggtgatagccgggctgccgaaagcgccttccaccttcaacccgctctactcaatggatcgtgccgtcgcgcggcgtaacgtcgtgctgtcgcggatgctggatgaaggatatatcacccaacaacagttcgatcagacacgcactgaggcgattaacgctaactatcacgcgccggagattgctttctctgcgccatacctgagcgaaatggtgcgccaggagatgtataaccgttatggcgaaagtgcctatgaagacggttatcgcatttacaccaccatcacccgcaaagtgcagcaggccgcacagcaggcggtacgtaataacgtgctggactacgacatgcgccacggctatcgcggcccggcaaatgtgctgtggaaagtgggcgaatcggcgtgggacaacaacaaaattaccgatacgctgaaggcgctgccgacctatggtccgctgctgcctgccgcagtcaccagcgccaatcctcaggaagcaacggcgatgctggcagacgggtcgaccgtcgtattgagtatggaaggtgttcgctgggcgcgtccttaccgttcggatactcagcagggaccgacgccgcgtaaagtgaccgatgttctgcaaacgggtcagcaaatctgggttcgtcaagttgacgatgcatggtggctggcgcaagtgccggaagtgaactcggcgctggtgtcgatcaatccgcaaaacggtgccgttatggcgctggtcggtggctttgatttcaatcagagcaagtttaaccgcgccacccaggcactgcgtcaggtgggttccaacatcaaaccgttcctctacaccgcggcgatggataaaggtctaacgctggcaagtatgttgaacgatgtgccaatttcccgctgggatgcaggtgccggttctgactggcagccgaagaactcaccaccgcaatatgccggtccaattcgcttacgtcaggggctgggtcagtcgaaaaacgtggtgatggtacgcgcaatgcgggcgatgggcgtcgactacgctgcagaatatctgcaacgcttcggcttcccggcacaaaacattgtccacaccgaatcgctggcgctgggttcagcttccttcaccccaatgcaggtggcgcgcggctacgcggtcatggcgaacggcggcttcctggtggacccgtggtttatcagcaaaattgaaaacgatcagggcggcgtgattttcgaagcgaaaccgaaagtagcctgcccggaatgcgatattccggtgatttacggtgatacgcagaaatcgaacgtgctggaaaataacgatgttgaagatgtcgctatctcccgcgagcagcagaatgtttctgtaccaatgccgcagctggagcaggcaaatcaggcgttagtggcgaagactggcgcgcaggagtacgcaccgcacgtcatcaacacaccgctggcattcctgattaagagtgccttgaacaccaatatttttggtgaaccaggctggcagggtactggctggcgagcaggtcgtgatttacaacggcatgatataggcggaaaaacgggtaccactaacagttcgaaagatgcgtggttctcgggttacggtccgggcgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggaacagccgctgacgccgccaccgggtattgtgacggtgaatatcgatcgcagcaccgggcaattagctaatggtggcaacagccgcgaagagtatttcatcgaaggtacgcagccgacacaacaggcggtgcacgaggtgggaacgaccattatcgataatggcgaggcacaggaattgttctgattaaaaaggcgcttcggcgcctttttcagtttgctgacaaagtgcacttgtttatgccggatgcgggtgaacgcgttatccggccaacaaaaaattgaaaattcaataaattgcaggaacttcgtaagcctgataagcgttgtgcatcaggcaaacttcacgcatttacactcgcccctgccctttcaaccattcgcgcacgaggaacagcgcgctgacattacgcgcttcgttgaagtcaggggcttccagcaaatccatcatatgcgccagcggccagcgcacctgtggtaacggctctggctcatcgccttccagtgattccgggtagagatcttgcgctaccacgatattcattttgctggaaaagtaagacggtgccatgctgagcttcttcaaaaaagtcagatcgttcgcaccaaatccaacctcttcttttagctcgcggttagcggcttcaaagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctttcgacggtaaacagtcgggaacgggctacagtttcaacattcagaatggtgggtttttgtaatgatttgctcatcgtgggatctatgctgtgaaatcagcggttattgtgcgatatcggacacgctttcggcaatgtgaattgcatgttatttacatttatgtaacttaataaataatcgtcctcaaatcaaattaaaagtcaataggttgaaataactccaggaatttgctgatattccgccttcagagggtttgctatgatcagcggttactgtgatgtgcttaatgatgctcaagttaaactccacgcttgccgatagccaaccgcagaatcatgtattgtgtccggtgcgactgaccacgcctgacagactaagtaagatggggaaagcatgagcaccattgtgatttttttagctgctttgctggcctgctcactacttgcgggatggctgataaaagtgcgatccagacggcgtcagctgccctggaccaacgccttcgtggatgcgcaaacgcgtaaactcacatctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttatggcatctctaccgacgatccgaataaatggcgttactacctcgattcggtagaagtccacctgccgcctttctgggaacagtacatcaacgatgagaataccgttgaactgattcataccgattcgctgccgctggttatttcactcaacggtcatacgctgcaggagtacatgcaggaaattcgcggctatgccttgcaacctgttccgtcaacgcaggcgtcgattcgcggggaagagagcgagcaaatagaactgctcaatattcgcaaagaaacgcacgaagagtatgcgctgagtcgtccgcgcgggctgcgcgaagcgttgctgattgtcgcctccttcctgatgttctttttctgcctgattaccccggatgtctttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatcttggtcaacaaaccgatatcgatatctatctcgaccgccacgtagtgcgtcaggggcgatatctttcgctgcatgatgaagtaaaaaactttccgttacagcactggctgcgcagtacgattattgctgcgggctcgctattggtgctgtttatgctgttattctggatcccgctggatatgccgctgaaattcaccctctcgtggatgaaaggcgcgcagaccattgaagccaccagcgtgaaacaactggctgacgctggcgtgcgggttggcgatacattgcgtattagcggtacgggaatgtgtaatattcgcacttccggtacctggagcgcgaaaaccaactcaccttttttaccgtttgactgctcgcagatcatctggaatgacgcccgctcattgccattaccagaatctgaattggtcaacaaagcgacggcattgaccgaagcagttaatcgccagctgcaccctaaaccggaagatgaatctcgcgtcagtgcctcattacgttcagcaattcaaaaatccggtatggtattgcttgatgattttggcgacattgttctgaagacagcagatctgtgttctgccaaagatgactgtgtgcgactgaaaaatgcgctggtcaatctcggcaacagtaaagactgggacgcgctggtaaaacgcgccaacgccgggaaactcgatggcgtgaatgtgttattacgcccggtgagtgcggaatcgctggataacctggtggccacctctaccgcgccgtttatcacgcatgaaacggcgcgagcggcacaatcactaaacagtccggcccccggcgggttcctgattgtcagcgacgaaggcagcgattttgttgatcagccctggccttcggcatcactttacgactatccgccgcaagaacagtggaacgctttccagaaactggcacaaatgctgatgcatacgccgtttaacgccgaaggtatcgtcacaaaaatcttcactgacgccaatggtacgcagcatattggccttcatccgatcccggatcgttccggcctgtggcgctatctcagcaccacgctgctgctactgacgatgctgggtagcgccatttataatggcgtacaggcctggcgtcgttaccagcgccatcgtactcgcatgatgaagattcaggcctattatgaaagctgcctgaacccgcaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgcttgacctcgccttcgataactatttctggcaaaagctggtgcctgaaacatggggcgcgaaaaacggagttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaaacagcgaattttgctcaccaatgcgcatccgcacaacctggcggtaaaacttgagcataccggtctggacgcacaccttgatttattactttccacccacacatttggttatccgaaagaggatcagcggttatggcatgcggtggccgaagctacgggtcttaaagctgaaagaacgctgtttattgatgacagcgaagcgattctcgatgctgccgcgcaatttggtattcgttactgcctcggtgtgactaatcctgactccgggattgccgagaaacagtatcaacgccatccgtcactgaatgactaccgccgcctgatcccctcgctaatgtgaaggagatgccatgaaagaaaaacctgctgttgaggttcgactggataaatggctatgggctgcccgtttttataaaacccgcgcgctggcccgtgaaatgattgaaggcggtaaggtgcattacaacgggcagcgcagcaagccaagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcatccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgttcgcggcgaactggtaaccgtttcggaaaccctgcaacagatccttgagaatcacgattatccgcagcccgttaaaaacgtgctggcagaactgctggttgcgaccagcctgttaaccgctacgttgaagtttgatggtgatatcaccgtacagctgcaaggcgacggtccgatgaatctggcggttattaacggtaacaacaaccagcagatgcgcggtgtggcgcgcgtgcagggcgaaattccagaaaatgccgacctgaaaacgctggtcggcaatggttacgtggtgatcaccatcactccgagcgaaggcgaacgctatcagggcgtggttggtctggaaggtgataccctggcggcctgcctggaagattactttatgcgttctgaacagctgccgacgcgcctgtttattcgcaccggcgacgtagacggcaaaccggctgcaggcggaatgttgttgcaggtaatgcctgcgcaaaatgcccagcaggacgactttgaccacctggcgacgctaaccgaaaccatcaaaaccgaagaactgctgactttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagtcgatagcatcctggcggaagatggcgaaattgacatgcattgtgattactgcggtaaccactatctgttcaatgcgatggatattgccgagatccgcaacaacgcgtctccggcagatccgcaagttcattaatgagtatgtccggcagagaggactctgccggattttacgactaatacacctgatgcgctttgtcactcattcagattcacatccagcctttcaccatccactacaagatcgcgccacgctttaggcctcgtccccagctttccatccttcgcagcagcgagtaatttttctttcgttatttggcgcggaagtaaactcatatcaagcgcgtcccattcttttctggctgagtcaaagccatagacaatgactctgtcatcattaaaagcaaacaggatccgctccgcctgaccatcactattcagatcttgctcgaccagtacgcaggcgtctttttcaatacaggtcatcacgttatagcgatcctggattaaggccgaccagaatgtcgcatccggtttaccagaacctggggcaattaacacattatcggctaatactttttccgatacctgttcctgaagatgttgctctccatctaacgccatcagcagatcccgcgcgcgtttcgggtctttcatatactcggcatcgcttttcagcgactcaagcgccgcacgtccatagcgaccgctctgttcgagcatgtagatagttacctggtctggcgtgtttttgccgctctgataacgcgccatatgactgttcacgctaatgcgcatactgtccagcaccggcgaattaagaagcaccagtattaccaacaccaataacgaaaccacaaggttcactttgccctgaagatcaaggggattttgccctttacgccagacgatactgacaaaataccccagcgaccataccagtaacaccagcaccgccagcgcgccctgcaagcggtcggcagtccagccgtactgagcgacccgcagccatagcgcccaggcggcggcgaacacatacagcggagcaaccagcaaagcggttttaatcaggcaacgcaatggccccgtccagggaagtgacgctttttgcggatcgaggacaatagccattaagatcaattgcaaaaaggccagcgttaacagcaacccagcggcggagatgtggcgagaaatcgcgctcaggcccgtaaacggcagggtgataataaacatcagggttagcaatgatactaacggcagcaaccccgtggcgattaacgtgaacaacttttgaatagagtcgattaaacgtgactgtgttcgcgcgaggatcaccgccagcgcggtaaccagacctaacgtgagataaataaaccagtcggttgcaaaaaagagcgttttgaaaaacgtgatgccaacaagtttaaacaactcactccacagtaaaagcaccagccacgtcaggccattggcgagaaaaatcaccagtaatataagtacgttatgccatactgactggtaaaagtagcgatagcggctactgtcattgcggatgcgaaggctttgttgtatccacggtagcaacaacattgccatcagcagcagatagcagccaaaatcccaaagcgccttttcagctctccagggggtcatgccatcagtttgccacttcagccagccgctcattcccagcgtggcaataaacaccagcgccagccatccccaaaggcgattctgtttaaaggagatcacggagaagagtaaaacggatgaaaacgcgacggtcgcaggcacgccataaacaatccaactgagattttttccggcaagccaggcgatcagcaggtagcaaaccaccccctgaagtaatccggtagcaatcatcccccagcgtgttgccggtgaaagttcaacgttatccatgttgtttatccagaatcaaaaggtgggttaattatcgcatccgggcagtagtattttgcttttttcaaaaaataatcaaaaaaagttagcgtggtgaatcgatactttaccgattgaatttgcatcaatttcattcatgaatgcgattccactcacaatattcccgccatataaaccaagttttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgatctgctgtatcaggaagagctggacccgagcctgaccggttatgagcgcggggtgttaactaatctgggtgccgttgccgtcgataccgggatcttcaccggtcgttcaccaaaagataagtatatcgttcgtgacgataccactcgcgatactttctggtgggcagacaaaggcaaaggtaagaacgacaacaaacctctctctccggaaacctggcagcatctgaaaggcctggtgaccaaacagctttccggcaaacgtctgttcgttgtcgacgccttctgtggtgcgaacccggatactcgtctttccgtccgtttcatcaccgaagtggcctggcaggcgcattttgtcaaaaacatgtttattcgcccgagcgatgaagagctggcaggtttcaaaccagactttatcgttatgaacggcgcgaagtgcactaacccgcagtggaaagaacagggtctgaactccgaaaacttcgtggcgtttaacctgaccgagcgcatgcagctgattggcggcacctggtacggcggcgaaatgaagaaagggatgttctcaatgatgaactacctgctgccgctgaaaggtatcgcttctatgcactgctccgccaacgttggcgagaaaggcgatgttgcggtgttcttcggcctttccggcaccggtaaaaccaccctttccaccgacccgaaacgtcgcctgattggcgatgacgagcacggctgggacgatgacggcgtgtttaactttgaaggcggctgctacgcaaaaactatcaagctgtcgaaagaagcggaacctgaaatctacaacgctatccgtcgtgatgcgctgctggaaaacgtcaccgtgcgtgaagatggcactatcgactttgatgatggttcaaaaaccgagaacacccgcgtttcttatccgatctatcacatcgaaaacatcgttaagccggtgtccaaagcgggccacgcaacgaaagttatcttcctgaccgcagacgcctttggtgtgctgccgccggtttctcgtctgactgccgatcaaacccagtaccacttcctctctggcttcaccgccaaactggctggtacagagcgcggcatcaccgaaccgacgccaactttctccgcctgcttcggcgcggcattcctgtcgctgcacccgactcagtacgcagaagtgctggtgaaacgtatgcaggcggcaggcgcgcaggcgtatctggttaacaccggctggaacggcactggcaaacgtatctccattaaagatacccgcgccattatcgacgccatcctcaacggttcgctggataacgcagaaaccttcactctgccgatgtttaacctggcgatcccaaccgaactgccgggcgtagacacgaagattctcgatccgcgtaacacctacgcttctccggaacagtggcaggaaaaagccgaaacgctggcaaaactgtttatcgacaacttcgataaatacaccgacaccccagcgggtgccgcgctggtagcggctggtccgaagctgtaatgatttgaagctggagaatatctatccagtatcttatagaaagcaaaacgggaggcaccttcacctcccgtttttttacccttcttttgtcatgccctgcgcccgcgttaccggcactggcagccaggcgcgaatggaaagcccgccccgttcgctggtgccaagctccagcatcccgttatggttatccacgatacgctgcacaatcgccagccctaatcccgtgccgctaatggtgcgcgcactgtcgccacgaacaaacggctggaacaggtgcttacgttgttccggcgcaatacccggaccgtcatcttctacctggaaccaggcgcgattcggctccgtgccgctgctgactttgatccagccattgccgtaacgggcggcgttgaccaccatattcgccaccgcgcgtttgatcgacagcgggtgcattttcacctcaatgctaccggggtaaagcgcggtttcaatttcccgctcatagccactttcggcagcaataacctcaccgagtactgcgttgagatccgccatttccatcggcatctcctgcccggtgcgcaggtagtcgataaactgctcaatgatggcgttgcactcttcgatatctttattgatcgattctgccaggtagccatcctgctcgctcatcatctcggttgccaggcgaatacgcgtcagcggcgtgcgcagatcatggcttacccccgccatcagcagcgtgcggtcatccgccagttgcttaacaccagccgccatatggttaaaggcgcgggtaacggaacgcacctccgaagcgccatattcacgcagcggcggcggaataatccctttacccacctgcaaggctgcgtgttcgagatcgaccaatggtcggttctggatacgaataaacagccacgccccgcctatcgccaatagcataatcgccaacgtataacggaacagcggggagaaatcgccctgatgaatttcggttagcggcacgcgtacccagatattgggcgacaaccaggttttcagccagacgacaggcgaacttttgttgacctcgacgcgaacttccgtcggaccgcccagttgctgcgccatctgatggcttaagaattcatagtgttgcgcccaacgcagacctgcctcttcggcagcttcgttggaatagagagagatccccagctcacggtagatctcccgacggaaagcgggaggcacaaccaactgcgtgccgtcctccagttgcagtttgtcggtcatcaacatacgcacttcgtacgcgaggactttattaaactgctggaggctcggcaaaatcgcgaagttcagcaccaccagataagtcgtcaccaggctgacgaacagcaaggtgacgatgagcaataacgtacgggcaaatgaacttcgtggcgagaagcgcaatcgcctcatgctttagaaccgtccggtacaaagacgtagcccagaccccagacggtctgaatgtaacgcggatgcgccggatcttcttccaccatgcggcgcagacgcgaaatctgcacgtcgatggagcgttccattgcggaatattcacgaccacgggcaaggttcatcagcttatcgcgggagagcggctcacgcggatggctgaccagcgccttaagtaccgcaaactcaccactggtgagcggcatcggctcgtcttcgcggaacatttcgcgcgtaccgaggttaagtttgaacttaccgaaagcaattaccgcctcttcctgtgacggtgcgcctggcagttcgttcgcctgacgacgcagcaccgcacgaatgcgggccagcaattcacgcgggttaaacggttttggaatgtaatcgtcagcgccaatctccaggccaacgatacggtccacttcttcccctttcgccgtcaccataatgatcggcatcggattgctctggctacgaagacgtcggcaaatcgacaagccatcttcaccaggtaacatcaaatccagtaccataagatggaaagattcacgagtcagcaggcgatccatctgttctgcattagcgacgcttcgaacctggaagccttgttcggtgagataacgttccagcagcgcgcgcaggcgcatgtcgtcatcaaccaccagaatcttgtagttctcttgcattgtttatactcccaaaggttcgcaacaatttgtaagcgtgtattcttaaaaaagctcacgttcgtcaccagctaaatctggtatgaatttcagcctaaattgttacaaagcatattaaacagcagcttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaagaaagtgacctgggccgcaagtctgggcgaccgcagcgaaaatgctgactatcagtataataaaaagcgcctgcgtgaaatcgaccgtcgcgtgcgctatctcactaaatgcatggaaaatctcaaaatcgtcgattactccccgcagcaggaaggcaaagtcttttttggcgcgtgggtggagattgaaaacgacgatggtgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaatgccatcaacgccaccctaagcaaaaccgaactcgaagacctctacctgccctacaaacctaaacgccgcacccgtgggcaaatcgccattgaagcagggcttgagccgttggccgatctgctgtggagcgatccgtcacacacgccagaagtcgccgctgcacaatatattgatgccgataaaggcgtggcagataccaaagccgcgctggacggcgcgcgctatatcctgatggaacgttttgccgaagatgctgcgctgctggcgaaagtgcgtgattatctgtggaagaacgcgcatctggtctcaaccgtggtgagcggtaaagaagaggaaggggcaaaattccgcgactatttcgatcatcacgaaccactgtcaacggtgccttctcaccgcgcgctggcgatgttccgtggtcgtaacgaaggcatacttcagctttcgctgaatgccgatccgcagttcgaagagccgccgaaagagagctattgcgagcaaatcatcatggaacaccttggcctgcgcctgaacaatgccccggcggatagctggcgcaaaggtgtggtgagctggacgtggcgcatcaaggtgttgatgcatctggaaactgaactgatgggcaccgtgcgcgaacgcgcggaagatgaagcaatcaacgtctttgcccgtaacctgcacgatctgctgatggcggcccctgccggactgcgtgcaacgatgggcctcgatccgggtctgcgtaccggggtaaaagtggcggtagtcgatgcgacaggtaaactggtggcgaccgataccatttatccgcataccgggcaggccgcaaaagcagcgatgaccgttgctgcgctgtgtgaaaagcataacgttgaactggtggcgattggcaacggtacagcttcccgcgaaaccgaacgtttctatctcgacgtgcagaagcagttcccgaaagtgaccgcgcagaaagtgatcgtcagcgaagctggcgcgtcggtttactcggcttccgagctggcagcacaggaattcccggatctcgacgtttcgctgcgtggcgcggtgtctatcgcccgtcgtttgcaggatccgctggcagagctggtgaaaatcgatccgaaatctatcggcgtaggtcagtatcagcatgacgtcagccagacgcagctggcacgcaaactggatgcagtagtagaagactgcgtaaacgccgttggcgtcgatctcaacaccgcttctgttcctctattaacccgtgtggcgggcctgacgcgcatgatggcgcaaaacatcgtggcctggcgcgatgagaacggccagttccagaaccgtcagcaactgttaaaagtgagccgtctggggccgaaagccttcgagcagtgcgcgggcttcttgcgcattaaccacggcgataacccgctggacgcctctaccgttcacccggaagcctatccggtggtggaacgcattctggcagcaacacagcaggcactgaaagatctgatgggtaacagcagcgagctgcgtaacctgaaagcgtctgactttactgatgagaaattcggtgtgccgacagtaactgacatcatcaaagagctggaaaaaccgggtcgcgatccgcgtccggaatttaaaaccgctcagtttgctgatggcgtcgagacaatgaacgacctgcaaccgggtatgatcctcgaaggcgcggtgaccaacgtcaccaactttggcgcgtttgtcgatattggcgtgcatcaggacggcctggtccacatctcttcattgtcgaacaagtttgtggaagatccgcataccgtggtgaaagcgggcgacattgtgaaggtgaaagtgctggaagtggatcttcagcgcaaacgtatcgccctgaccatgcgtctggacgagcagcctggcgaaaccaacgcccgtcgcggcggcggtaatgaacgcccgcaaaacaaccgcccggcagccaaaccgcgtgggcgtgaagcgcagcctgccggtaacagcgcgatgatggatgcgctggcggcggcaatgggcaaaaaacgttaaacgccctgatagacaaacgtaaacctgccagataaagcgttcacgccgcatctggcaacgaacgccttgcctgacataaaagtgccggagaatatctccggcctttttattccacaagcaaactcataatatatcccgttaatatttatcacttcattaacaactgaaaccttaattaaacattaaccagccctaataattcgtcatgcgaattatattttcgctgcgatataaccttgagccatatcaacattgagtcagattattattcaaaccaacattcacacacattttaagtattgctgatagaaaccattctcattatcattgtactgttgattatttaatctctccttcgttggcaaatcatctggtctcatgtcgctgtcaaacgccccatgaggtagttatccagttaatgagaaacaagtaggcacctatgcaatacactccagatactgcgtggaaaattactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccattggcttaattggtaatccaaattctggcaagacaacgttatttaaccagctcactggctcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgcagacctgctgattaacgtggtggatgcgtctaaccttgagcgtaacctgtacctgacgctgcaactgttggaactcggcattccctgcatcgtggcgctgaacatgctcgacattgccgagaagcaaaatattcgcattgaaattgatgctctgtcggcgcgtcttggctgcccggtgatcccgctggtttcaacccgtggtcgcggtattgaagcgctcaagctggcgattgatcgctataaagctaacgaaaatgtggaactggtgcattacgctcagccgctgctcaacgaagcagattcactggcaaaagtgatgccttccgacatcccgctgaaacaacgtcgctggctgggcctgcaaatgctggaaggcgatatctacagccgcgcctacgccggtgaagcgtcgcagcatctggatgccgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcttgctggctatcaacatcggcggggcgttacagccgctgtttgacgtcggctccgtagcactctttgtgcatggtattcagtggattggctacacgctccacttcccggactggctgactatcttcctcgcccaaggcctgggcggtggtattaacaccgtgctgccactggtgccgcagatcggcatgatgtacctgttcctctccttccttgaggactccggctatatggcgcgtgcggcgtttgtgatggatcgtctgatgcaggcgctgggcttgccggggaaatcctttgtaccgctgatcgttggtttcggttgtaacgtaccgtcggtaatgggcgcacgtacgcttgatgcaccgcgtgaacgtctgatgaccatcatgatggcaccgtttatgtcctgcggcgcgcgtctggctatcttcgcagtattcgcggctgccttcttcgggcagaacggtgcgctggcggtcttctcgctgtatatgctgggtatcgtaatggcggtgctgacgggcctgatgctcaagtacaccatcatgcgcggtgaagcgacgccgtttgtcatggagctgccggtctaccatgtaccacacgttaaaagcctggttatccagacctggcagcgtctgaaaggcttcgttctgcgtgctggtaaagtgattatcattgtcagcattttcctgagcgccttcaacagcttctcgctgagcggaaaaatcgtcgataacatcaacgactcggcgctggcttccgtcagccgggtgatcaccccggtcttcaagccgattggcgtacatgaagataactggcaggcaacggttggcctgtttacaggtgccatggcgaaagaagtggtggtgggtacgctcaacaccctctacaccgcagaaaatattcaggacgaagagttcaatccggcggaatttaacctcggtgaagagctgttcagtgcggtagatgaaacctggcagagcctgaaagacaccttcagccttagcgtactgatgaaccccattgaagccagcaaaggcgacggcgaaatgggtaccggggcgatgggcgtgatggatcagaaattcggtagcgcagctgccgcatacagctacctgattttcgtcctgctgtacgtaccgtgcatctcggtgatgggggctatcgcgcgtgaatcaagccgtggctggatgggcttctccatcctgtgggggctgaatattgcttactcactggcaacattgttctatcaggtcgccagctacagccagcatccaacttacagcctggtgtgcattctggcagttatcctgtttaacatcgtggttatcggtctgctgcgccgcgcgcgtagccgggtagatgtcgaactgctggcaacgcgcaaatcggtaagcagttgctgtgcggccagtaccactggcgattgccactaaggacacgacaatggcttcgctcattcaagtgcgtgatttactggcattacggggccgtatggaagcggcccagattagccagacactgaacactccgcagccaatgattaacgccatgctgaaacagctagaaagtatgggaaaagcagtgcggattcaggaagaacctgacggctgtctttccggcagttgtaaaagctgcccggaaggaaaagcctgtctgcacgaatggtgggcgttgcgttaaccatactccatcacctgttttgaaaagcccggtatgcgtttgcatccgggcttttttgcgtgcggctttccataaaaatgcaacccttgcagcgcgacgtaaattcctctgaaagcgtctcgcagggatgaaaactcgctaatgcacaggtgtggagtggcgcgtagagtcgcggcattcaaacaacaggtgaaggaacgccatgagcaaaaagcagagttccaccccacacgatgcgctgttcaaactctttttacgccaaccggagacggcacgcgattttcttgcgtttcatttaccggcacccattcacgcgctctgtgatatgaaaaccctcaagctggagtcgagcagctttattgatgacgatctgcgtgaaagctattccgacgtgctgtggtcggtgaaaacggaacaaggaccaggatacatctattgtctgattgaacatcaaagcacctcaaacaaactgatcgcatttcgcatgatgcgctacgccattgccgcaatgcaaaatcacctggatgccggatacaaaaccttgccgatggtggtgccattgttgttttaccacggtattgaaagcccctatccctattcgctgtgttggcttgattgtttcgccgatctcaacctggcaaggcagctttatgcctctgcatttccgctgattgatgtcaccgtcatgcctgatgatgaaatcatgcagcaccgacgtatggcactgctggagttaattcaaaaacatattcgtcaacgcgacctgatggggctggtagagcaaatggcctgcttattaagtagtggatacgctaatgacagacaaatcaaagggctgtttaattacatcttgcaaaccggcgatgcggtacgttttaacgattttatcgacggcgttgccgaacattcaccgaaacacaaggagaacttaatgactattgcggaaagattgcggcaggaagggtttcagaaaggtatacgtaccaacgccctaaatattgccaaaaccatgctggacgccggagtttctcttgaggacgttctgcgatttaccagcctgacggttgaagaccttgctgaaataaatcatcaataacgtaaaggatggttttaatgacagatgcagaaagagaatatcttattatttacctgattggttatttattgggtcgacgcctggaagccctggatatcgccaaaagaatgctgtaatccggagtccctcttgcggacatcatgcgttttaccggggtgtcagaagaagagttggctgcggcgagtcagtaaagttctgtctcgccatttcaaaagctgtctacaccctctgcttcaacgccaccagcaggtgatgaaactcgaccggatgcgaaataaacggcgcatgggccgctttggcgaaaatgtacgactcgctgtgcggccagagtttatccagcatcggcactactttgcgcggcaccagaccatcaagatagccatacaatcgcaaaaacggcatggacacgttttgcagcggcagacggagatcgaccgttttgaggatttccagcccaccattgagcacgtccacctccggcatcggtaacgccagtacggttttcttcaacgcccgcgcatcctggcgcgccgtttcagtacccatggtttgtaacgccaggaaccgctccactgtacgctgaaaatcatcactcagctgctgctgaaatcccgccagcacgtccggttttatccccggccactcgtcacgagcactaaaacaaggcgacgacgccacggtgaccagcgcctgaacacgctcgggatgggttaacgcaatctggcttgccaccagcccgcccagactccagcctaaccaaatggctttatcaggtgcctgtcgcagcacggcttcggccatatcagcaagcgacagcgcaccaaatccccgactgcgcccgaaaccgggcagatcaacaaggtgcagcgtaaaatgcgagctaagttcctcgtcaatgcaacgccacacttcggcattcagtccccatccgtgcagcagcacaagatgaacattcccctgacctttggtctgccaccagatgttattcatccgctattgttctcttttgacttacaaggatgaacatatgctaacagtaccgggattatgctggctatgccgaatgccgctggcgttaggtcattgggggatttgttcggtatgctcacgcgccgcccgtacagataaaacgttatgcccccaatgtggattacccgccacacactcacatcttccctgcggtcgctgcctgcaaaaaccgccgccctggcaaagactggtcacggttgccgactatgcgccgccgttaagcccgctaatccaccagcttaagttttcccggcgcagcgaaatcgccagcgccctgtcacgtctgttactattggaggtcttacacgctcgtcgcaccaccgggttgcaattgccggatcgcatcatcagcgttccgttatggcagcggcgtcactggcgtcggggatttaatcagagcgatttgctgtgtcagccgttatcacgctggttgcactgccgatgggatagcgaagccgtcacacgaacacgggccactgcgacccagcattttctcagtgcccggctacgcaaacgcaacctgaaaaatgcctttcgtcttgaattgcccgtgcaaggtcgccatatggtgattgtggatgatgtcgtcaccaccggaagtaccgtcgcagagattgcgcagttgcttttacgcaatggtgcggcgactgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaatcaggaagaagggacacaaatccgcgtatttgtgattaaccctggcacgcctaacgctgaatgtggcgtttcttattgtccgccggacgctgtagaagccaccgacactgccctgaaatttgacctgctgaccgcgtatgttgatgagttaagcgctccttacctggaagatgcagagatcgactttgttacagaccagttgggttcccagttaacgctgaaagcgcctaacgccaaaatgcgtaaagtcgcagacgatgcaccgctgatggagcgcgtggagtatatgctgcagtcgcagatcaacccacagcttgctggtcacggtggtcgcgtttcgctgatggaaatcaccgaagacggttacgccattctgcaatttggcggcggctgtaacggttgttctatggtagatgtgacgctgaaagaagggatcgagaagcagctgctgaacgaattcccggagctgaaaggtgtgcgcgatctcaccgaacaccagcgcggcgagcactcctactactaagttatcccctcttttgtagattgcccgatgcgacgctaaagcgtcatttcgggcctacgttgaacatgtgccagacgttggcgcagcattgctttggcaaacccctcccttcgtttccccgcgataatatgaccaacctctcataatttaaatttaccccgctctggtgattctcaaacgccggatgttacccgtatcattcacgtgggtaccaaacatactcctgacatctgactacaataattagttttagtgggtatcagtcgtggtgccgcaatatctctgttcccgattgggataattagagtttgtcgtcagaaaattgacgttacccataacaaatgaaaggccaggtaaatcatgccattagtcattgttgctatcggtgtaatcttgttattactcctgatgatccgcttcaaaatgaacggcttcatcgctctcgtcctcgtggcgcttgctgttggattaatgcaaggaatgccgctggataaagttattggctccatcaaagctggtgtcggcggaacgctcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatgctgccgctggtgtttaccatcgcggcttctgcgaatattccactgctgtatgttggtgtaccaatggcagctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgttgaaaggtatcgataagccaattccggaaggtctctacagcgcgaaaaccttcagcgaagaagagatgccgagctttggcgtcagcgtctggacctctctggtgccggtagtactgatggcgatgcgtgcgattgccgaaatgatcctgccgaaaggtcacgctttcctgccggtagcggagttcctcggtgacccggtaatggctacgctgattgccgtgctgattgcgatgttcacctttggtctaaaccgtggtcgttcaatggatcagattaacgacacgctggtttcttccatcaaaatcattgcgatgatgctgttgatcatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggtgggttccggtagtgtgattttctctcatgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttgataacactgactgccggatgcatcgcatccggcatcaaccgcactctacttcttcttcgctgcagctctgcgccgtctgtccaaatccttcagcaacttgttcacgccatcatcggcaaacatcgtctcaagcgttgcggaaagcttgcgtcgccagtttttatactggtaactggtgccaggaatattcaccggttcggccatatccagccagtcttccggctgtagtcctaacagagcactgttactgtcggcaatgtagcgctgcaaaccacggttcagcgtcggcgtcatcgacatcaacgatgccttatgcccggcacgttttggcagacaaccatatttatgcagtgcatccagcagcccttgcttcgccagttcgcgatcctgatacagaccgcgcagtaccacttcatccggatacagccccagggttttgcccagcgttagatccccgctctcccagtaaccacgcagcgttggcaggtcgtgtgtcgccgcaaccgccatcgactgctccgggtacgctttcggtgaacggaacgtcttctcgtggtcgttttcgaaatagagcactttgtaggagtacacaccgctgctgcgcagcttaccgacaatctctaccggtacggtaccgagatcttcaccaatcaccatacagcgatgacgtttactttcgagtgccagaatcgagagcagatcatccaccggatagtgaacatacgcgccctgatctgccgtctcgccatacggtatccaccacaaacgcagcatcgacatcacgtgatcaattcgtaatgcgccgcagttttgcatattggcacgcaacagctcgataaacggttcataggcacgcgcggtgatgatatgcgggtccattggcggcaatccccagttctgccccaacgggccgaggatatccggcggcgcgccaaccgacgctttcaggcaatacagttcacggtcgcaccaggtttctgccccaccttctgctacaccaacggccagatcacgatacaagccaatcggcatttcatagccctggcttatctcccagcaggcggcaaactggctgtaagccagccactgcaaccagagataaaaatcgacgtcatcacgatgttcttcgcagaactggcgcacttctggtgaatccacgttctgatacatctctggccatgctggccagccccagcgcatttcgtcctctttcacttgctgggcatgtagcgcatcaaaggctgcctgccagaacaggctgtcgccctgctctgcaacaaactggcgaaacgcagtcatctgctcatcatcacgttgcgcgaaacctttccacgccattcgtaatgctgtcatttttagggtggtaaccgtggagtaatcaacccagtcggcatcccgcgcctgttgcagcgtctgttgcgtggtcggcaactgccaccaggcctgagcctcttcgctaagatggaaatcttcaactgcgttaacgtcgatataaatcacattcagccaacggcgagaagacgggctgtacgggctggcactttccggatttgccggatagagcgcatgaatcgggttcagaccgatgaacgacccgccacgttttgccacatcctcaagcatcgctttgagatcgccaaaatccccaataccccagtttttttccgatcgcagcgtataaagctgaacgcaggcaccccacagcttttgtttattcagcaacgcctgcggttcgtaacagcgtttcggggcgacaatcacccggcaatgcgcgcgctggtcgtcctgggtgagtgtcagcgtgtgataaccttccggcagcttcgtcggtagattgaacgctttgccccccgttacatggcctttgtactgcgttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctaatacccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtatagcacatccacctgcttttgtgcctctacataggctgcgaaatccgccatcaccagatacggatcgccgccctgtttgccgatactgtgcagcatctggtcgaaggcatgcttatcgccgtcgctgtatttgccgctttccagctctttcaatactgcgtccagcaccttatctttcttccgccatttcaccgggtcgtagcctttggccagaattgccttcacttgttccacggtatgaccaaaaataaagatattttcttcaccaactttctcggcgatttcaacgttcgccccatccagcgtaccgacagtaagcgcaccattgagcgccagtttcatattgccggtaccggaagcttctttacctgccgtcgaaatttgttcggagatatccgccgccgggatcagtttttccgccgccgaaacgcaataatccggcaggaacaccaccttcaatttgtcgccaacctgcggatcgttgttgatcacgtcagccactttgttgatcgcaaagataatgtttttcgccaggtagtagcccggtgccgctttcgcgccaaagaggaagacgcgcggtacgcgatcagcctgcgggttttcacgaatttctttgtacaacgccagaatatgcagcagattcaggtgctggcgtttgtattcatgcagacgtttgatctgaatatcgaaaatcgcctgtggattgatctcaataccggtacgaactttcacaaactctgccagacggactttattcgcctgcttgatctcgcgatattgctgacggaatttcgcatcatcagcgaatttttccagattgatcagttgatcgagatcgttagtccactcttttttcagtgatttatccaacagagccgccagtgccgggttgcactgtttgatccagcgacgtggggtaataccgttggtgacgttatggaatttgttcggccatagctggtgatattccgggaacagatctttcactaccagatccgagtgcagcgccgcaacaccgtttaccgcgaaaccgccaaccacacacaggttcgccatatgcacttgtttgtcgtgtaccaccgccagtttggcccacactttttcatcgcccggccaggttttttccaccagcgttttaaagcgagtattaatttcgttaataatctgcatgtggcgcggcagtaagcctttcaccagtttcacatcccagcgttccagcgcttctggcatcagggtatggttggtgtaagcgaaagttttgctggtgatggcccaggcgtcatcccagctcatctggtgctcatcgatcagcacgcgcagcagttctggaatggcgatagttgggtgggtatcgttcagctgaataacttcgtactccgccagttcgtgcagtttacgccccgccagatgatggcgacgcaaaatatccgctaccgaacaggcacactggaagtattgctgcatcaggcgcagctttttaccggcagtatggttgtcgtttggatagagaactttggtcagtttttccgcgttgataccctgctgttcggcgcgcaggaaatcaccatcgttaaatttagtcagatcaaacggatgcgcatgcgtcgcctgccacagacgcagtggctgcgccacgccattacgatagccgacaacggggagatcccacgcttgaccggtaatggtaaactccggctcccagcgtccatctttcgtcactttaccgccaatccctacctgcacatccagtgcttcgttgtggcggaaccacgggtagttaccgcgatgccagtcatccggcgcttcaacctgtttgccatcgacaaaagactggcggaacaaaccatattgatagttcagaccgtaacccgtcgcagactgaccgacagttgccattgagtcgagaaagcacgccgccagacgtcccagaccaccgttccccagcgccgggtcgatctcttcttccaacaggtcagtcaggttgatgtcataagccttcaacgaatcctgtacatcctgataccagccgagattcaacaggttgttgcccgtcaggcgaccaattaaaaactccattgagatgtagttaacatgtcgctgattcgccactggcttggcgaatggctgagcacgcagcatttcggccagtgcttcgctcactgccagccaccactggcgaggagtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcgaccacttaaagctagtgcaatccacaggattagcagcaaatcaatgccataccgcgcagaaaatctgtatctaagtgcaaaaaatggccgttgcgtattttcaaaaagcggaaggtaactctataaattaagtaaaggagtgaaacagtttcacaagtaaaatatcaagtgtgctccatctcattcttaatagatttattaagatcatctttttagatggcactttcatcagaaatgaagaagaaacccttgcttaaatgaaactgatgaacataaggaaaataccgtacaacccagtattcacgctggatcagcgtcgttttaggtgagttgttaataaacatttggaattgtgacacagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaattaagtcgtccggttcgactcgaccataccgtggttcgtgagcgcctgctggctaaactttccggcgcgaacaacttccggctggcgctgatcacaagtcctgcgggctacggaaagaccacgctcatttcccagtgggcggcaggcaaaaacgatatcggctggtactcgctggatgaaggtgataaccagcaagagcgtttcgccagctatctcattgccgccgtgcaacaggcaaccaacggtcactgcgcgatatgtgagacgatggcgcaaaaacggcaatatgccagcctgacgtcactcttcgcccagcttttcattgagctggcggaatggcatagcccactttatctggtcatcgatgactatcatctgatcactaatcctgtgatccacgagtcaatgcgcttctttattcgccatcaaccagaaaatctcacccttgtggtgttgtcacgcaaccttccgcaactgggcattgccaatctgcgtgttcgtgaccagctgctggaaattggcagtcagcaactggcatttacccatcaggaagcgaagcagttttttgattgccgtctgtcatcgccgattgaagctgcagaaagcagtcggatttgtgatgatgtttccggttgggcgacggcactgcagctaatcgccctctccgcccggcagaatactcactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgcactcatcacccgtgtgaccggcgaagaaaacgggcaaatgcgcctcgaagagattgagcgtcaggggctgtttttacagcggatggatgataccggcgagtggttttgctatcacccactgtttggtaacttcctgcgccagcgctgccagtgggaactggcggcggagctgccggaaatccaccgtgccgccgcagaaagctggatggcccagggatttcccagcgaagcgattcatcatgcgctggcggcaggcgatgcgctgatgctgcgcgatattctgcttaatcacgcctggagtttgttcaaccatagcgaactgtcgctgctggaagagtcgcttaaggccctgccgtgggacagtttgctggaaaatccgcagttggtattattgcaggcgtggctgatgcaaagccagcatcgctacggcgaagttaacaccctgctggcccgcgctgaacatgaaatcaaggacatcagagaaggcaccatgcacgcagaatttaacgctctgcgcgcccaggtggcgattaatgatggtaacccggatgaagcggaacggctggcaaaactggcactggaagagctgccgccaggctggttctatagccgcattgtggcaacctcggtgctgggtgaagtgttgcactgcaaaggcgaattgacccgctcactggcgttaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcgttccagctgatcaacgagcagcatctggaacagctgccaatgcatgagtttctggtacgcatccgtgcgcagctgttatgggcctgggcacggctggatgaagccgaagcgtcggcgcgcagcgggattgaagtcttgtcgtcttatcagccacagcaacagcttcagtgcctggcaatgttgattcaatgctcgctggcccgtggtgatttagataacgcccgtagccagctgaaccgtctggaaaacctgctggggaatggcaaatatcacagcgactggatctctaacgccaacaaagtccgggtgatttactggcaaatgaccggcgataaagccgccgctgccaactggttgcgtcatacggctaaaccggagtttgcgaacaaccacttcctgcaaggtcaatggcgcaacattgcccgtgcacaaatcttgctgggcgagtttgaatctgcggaaattgtcctcgaagaactcaatgaaaatgcccgcagtctgcggttgatgagcgatctcaaccgtaacctgttgctgcttaatcaactgtactggcaggccggacgtaaaagtgacgcccagcgtgtgttgctggacgcattaaaactggcgaatcgtaccggatttatcagtcattttgtcatcgaaggcgaagcgatggcgcaacaactgcgccagcttattcaactcaatacgctgccggagctggaacagcatcgcgcacagcgtattctgcgagaaatcaatcaacatcatcggcataaattcgcccatttcgatgagaatttcgttgaacgtctgctaaatcatccggaagtgccagagctgatccgcactagcccgttgacccaacgtgaatggcaggtcctggggctgatttactccggttacagcaatgagcaaattgcaggcgagctggaagtggcggcaaccaccatcaaaacgcatatccgtaatctgtaccaaaaactcggtgtcgcccaccgtcaggccgcggtacaacacgcgcagaaactgctgaagatgatgggatatggggtatgagtttagccggataatgcgccagatccggcttacatctttacatcattcaatgctcacccgcgttacgccatctgtttctatcaaaccaaaccgcaccggcaagaaacgctccaccacggcgatattggtcagcagatggcatgagggatgggcgaccgtaaattcccccgtacccgccagcgccatcggtagcaccagttggtcggcgagatattcccccaccgccgccgggcttgccaggtagcgtttcacctctttcaccaactgtgccgcgaccacctcggcactgacgcgcttttcaccgacgacaaaaaagcgttcggtgatattttcactttcgacttcaagcgagacggtattacccggcccctggtcgcgcggcaggttatgaatattctgttcatgcaaggaaaaactacccgccagtgtagcgatttcacgctcagcaacatggcgcggcacaccagccagtagcacctctccacgcatctgcacaatgttcccgcgctcgccaagttgcaagctattaaacgatgccaccggtgagacttccgttgctaccacgccgcctccggcaggataaaaaccgtgacgtaacagcgtggtttgctgatgaactcctattttcgccagcagcggctccagcacccgacggataaaatccgcaggcggggccgacgggttatcggtgccgccgctcacttcaacacgcgaaggtccatcggcaaaccacagcgcgggcagcaccgtttgcagcaccagcgtacaacttccggcgctaccgatagcaaagcggtaatcgccgccgcgcacggtgccaggtcggaagaccagacgctgcgaccccagctcagcgccttccaccgttgccctacaaatttccgcagccgcttttaccgcggtcagatgttggcgcaacagccccggtttcgcccgcccggcacgaatgccggtgatggtaaatggctggccggttatcatcgacaggctcagcgccgagcgcaggatctgcccgccgccttcgccctgtgcgccatccagcgcaatcatccttttcatcatttatccttttacgcacaccacctgacgcagggtatagataacttccaccagatcgctttgtgccgccatcaccgcatcaatatctttatacgccatcgggatttcgtcgatcacctcggcatctttacggcactccacatgcgcggtggcacggatttgatcttccacactgaacagttttttcgctttagtacggctcattacccgcccggcaccgtggctgcacgaacagaacgactcttcatttcccagcccacggacgataaagcttttcgcccccatcgaaccgggaataattccatattgaccagcacgcgcagacaccgcgcctttacgcgtcacatagatctcttcgccaaagtgctgttctttttgcacatagttgtggtgacagttgatctcttccatcgccagcgtttgtggctgttttaccgttttctgcgtaacgctctgcaacgccgttaccacgttttccatcatcgcatcgcggttaaggctggcaaaaagctgcgcccaggccacggctttcaggtaatcatcaaagtattccgtaccttccataaagtacgccaggtcacgcgatggcaacgtttcaagcgtttcctgcatctctttttgcgccagatcgataaagtaagttccgatggcattaccgattccgcgtgaaccggagtgcagcataatccacacctggtccgactcatcaaggcagatttcaataaagtggttacccgttcccagcgttcccaggtgtttatagttgttagtgttaaggaaacggggatatttttgcgttaaccactgataaccggcttccagctcagcccatttcgcatcgacgttaacaggcggattttcccatgcgcctttatcacgtttacaacgcccggtagtacgtccgtgcggtacggccgtttcaatcgcctgacgcagctctgccaggttttcaggcaggtccgccgccgttaacgcggtacgcagtgcgttcattccacagccaatatccacgcccaccgccgccggaataatcgcccctttggtcgggatcacgctaccaatggtggaacctttacccaggtgtacatcaggcattaccgcaatatgtttgaaaataaacggcatcttcgcggtattaataagttgctgacgcgcatcggcttctaccggcacgcctttggtccacatttttaccggagcattttcagtggtcagtaattcgtaattcattttgtttttctcttttcgttgtttgctgtcctgataattgcaaccgtcgtgccagaaaatcaaataagcatcttaattttttaattcattgtttttaaaaatattatatttttacgtccgtaaacggagatttcccgcaaagccgatttaccgataatgaaatctcgtcttttataaggatatctaagatgcgtaaaacagtggcttttggctttgtcggaacggtgctggattatgccgggcgcggcagtcagcgctggtcaaaatggcgtccgacactctgtctatgccagcaagaatcgttagttatcgatcggctggaattattgcacgacgcccgctcgcgctcgctgtttgaaacgcttaaacgcgatatcgccagcgtttcgccagaaacagaggtagtgggcgttgagattgaactgcataatccgtgggatttcgaagaggtttacgcctgcctgcatgatttcgcccgtggttacgcgttccaagctgataaagaagactatttaattcacatcaccaccggtacccacgtcgcgcagatttgctggtttctgctggcagaagcgcgttacctgcccgcccggttgatacaatcttcaccaccgcgcaaaaaagagcggcccgatagccctggcgcagtgacgattatcgatctcgatttaagccgttataacgccatcgccagccgctttgccgaggaacgccagcaaacgcttgattttcttaagtccggcattgccacgcgtaactcccacttcaaccgcatgattgagcagattgaaaaagtggcgataaaatcccgcgcaccgatcctgcttaacggcccgaccggtgcaggtaagtcatttctggcacgacgcatcttcgagctaaaacaggcgcggcatcagtttagcggcgcgtttgtggaagtgaactgcgccaccctgcgcggcgataccgccatgtcgacgctgtttggtcatgtgaaaggcgcgtttaccggggcgcgggaatcgcgtgaaggattattacgcagcgccaacggcggaatgttgtttcttgatgagattggcgaactgggcgcagacgaacaggcgatgttgctgaaagccattgaagagaaaaccttttacccgtttggcagcgatcgccaggtgagcagtgattttcagcttatcgccggaacggtgcgcgatttgcgccagttggttgccgaaggcaaatttcgtgaagacctgtacgcgcgaataaatctctggaccttcaccttgccaggattacgccaacgccaggaagatattgaaccgaacctggattatgaagtggagcgccacgcctcactcactggcgacagcgtgcgttttaacaccgaagcgcggcgtgcctggctggcctttgcgacctctccccaggcaacatggcgcggtaactttcgcgaactttctgccagcgtcacgcggatggccacctttgccactagcggacgcatcacactggatacggtggaagatgagatcaaccgtctgcgctataactggcaggagagtcgcccctccacgcttacggcgttgctgggcgcagaggcagaaaacatcgatctcttcgaccgtatgcaactggaacacgttatcgctatctgccgccaggcaaagtcgctttctgctgccggacgtgaactgtttgacatttcgcgccagggtaaagccagcgtcaatgacgcggatcggctacgcaaatacctggcgcgttttggtctgacatgggaagcaatgcaggatcagcacagctccagttgaatatgatggtccttcagcacctgcatcacgctcgcaggcggcatcgtgtcggtgtagacagcatcgaccatgctgatgctacccatattgaccattgcgttacggccaaattttgagtggtcgacaaccagcataacgtggcgcgagttctcaatgatggcgcgtttggtgcgaacttcgtggtaatcgaactccagtagcgagccgtcgctatcgatgccgcttatccccagaatgccgaaatcgaggcggaactgggagataaaatcgagcgttgcttcgccaatgatcccgccatcgcggctgcgtaattcgccaccggcaagaatgatacggaaatcctcttttaccatcagcgtgttagcgacgttgagattgttggtcacaatgcgtaaattgctgtgattaagcagcgcgtgcgccaccgcttccggcgtggtgccgatatcgataaacagcgtcgagccattgggaatttgctccgccactttgcgggcgatgcgctctttttcttcggtctgggtggccttgcgatcgtgccacggcgtattaaccgaactggaaggcagcgccgcaccgccatgatggcgcaggatcaggttttgctctgccagctcgttgagatcgcggcgaatagtctgcgggctaacggagaaatgctctaccagctcctcggtgctgacataaccctgctgtttaaccagttcgataataccgttgtgacgttgtgtttgtttcattgataaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcaacgcaaagataattaacccacgttgcaggtaaatgccactttgcggatcgcgttcgccacgtagccagacgtagcccatcagcgcatacaccacgccagaaagcccgccaaaccacggcccgctgaatttttgctgcacatagccgcttaacagggcgctaatgagagtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaacttcagcgtcggatcgaatggccaggccagccataacatcacttcctgatcgccgagaatttgcatggcgataaacaccaccacgcaggcgatcatcatcacccaggttaccggacctgcgcgttcacgcaaggcggcaaagaaaggataacggcgataatgcaggccactgccggtatggcccgcctgccagctggccgccagataacgcggatctgccgggttttcgagaaaacgcgccagctccgcccgcacgcgctcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactggcgctgccaggcttcaaaaccgccatcaatgctgtagaccacatcgtagccctgttgcagcagatactgcgccgcgcctttgctgctattgccgtgataacacatcaccatcaccggtgtgtcaaagtcgttatcacgcataaacgcgcccagtgtgtcgttagttaaatggaaagcctgggtcgcatgccccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttaccgcacagtttacgtcgaagcggcagataaacgccataatgttatacatatcactctaaaatgttttttcaatgttacccaaagcgcgattctttgctaatatgttcgataacgaacatttatgaactttaacgaaagtgaatgagggcagcatggaaaccaaagatctgattgtgataggtggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgactggtcagcgaggcgctggctgaacgtgaagtgctactgaaaatggccccgcatatcgccttcccgatgcgttttcgcctgccgcatcgtccgcatctacgcccggcgtggatgattcgcattggtctgtttatgtacgatcatctgggtaagcgcaccagcctgccgggatcaaccggtttgcgttttggcgcaaactcagtgttaaaaccggaaattaagcgcggattcgaatattctgactgttgggtagacgacgcccgtctggtactcgccaacgcccagatggtggtgcgtaaaggcggtgaagtgcttactcgtactcgtgccacgtctgctcgccgcgaaaacggcctgtggattgtggaggcggaagatatcgataccggcaaaaaatatacatggcaggcgcgcggcctggttaatgctaccggcccgtgggtgaaacaatttttcgacgacgggatgcatctgccttcgccttatggcattcgcctgatcaaaggcagccatattgtggtgccgcgtgtgcatacccagaagcaagcctacattctgcaaaacgaagataaacgtattgtcttcgtgatcccgtggatggacgagttttccatcatcggcaccaccgatgtggaatacaaaggcgatccaaaagcagtgaagattgaagagagtgaaatcaattacctgttgaaagtgtataacacgcactttaaaaagcagttaagccgggacgatatcatctggacctactccggcgtgcgtccgctatgtgatgatgagtccgactcgccacaggccattacccgtgattacacccttgatatccatgatgaagacggcaaagccccgctgctgtcggtattcggcggtaagctgaccacctaccgcaaactggcggagcacgcgctggaaaaactgacgccatattatcagggcattggtccggcgtggacgaaagagagcgtgctgccgggtggtgccattgaaggcgaccgtgacgattacgccgcccgcctgcgccgccgttacccgttcctgaccgaatcgctggcacgtcactacgcgcgcacttacggcagcaacagcgaactgttgctcggcaatgcaggggcgataagcgacctcggtgaaaatttcggtcatgagttctacgaagcggagctgaaatatctggtcgaccacgaatgggtccgccgcgccgacgatgccctgtggcgtcgcacgaaacaaggcatgtggctaaatgcggatcaacaatctcgtgtgagtcagtggctgatggaatatacgcagcagaggttgtcgctggcgtcgtaaggatgatgcccggttgcgaagtgcaaccgggctatttgaattccttagactattcattgtaaataattgaataacggccccagagctaaaatcgccaaacttaagcacgttacccaatcgccccacttcttcctatggcttctatttttgctacgccactggcaataatatcccaacgcaaaaccaagctgggcactaatcgggccgacaaaatcagtccacggctgcggccaaaaaggggaaaaattcaggggaagccagacaaatgtcagaaagaaatttcggatattttccagcaacgctgatttctctggagaaatataaagaatgaaattcgagagaattaaccagaaatagaccggagaaaagaccagccagcaatgtagcctgttttttaattcaggaggcgttctgcgggagaattgccaaccgatgccacccattacactgaaaaaaagtgcatattcaaccaataactcaagttgtaattcctgaagagaaatacgcacaaccaggagcggaaaggagaatattatttccgccagaaaagttaacgtgaatataagtacggctaaggcaataaccgtcggccataccaataatggtacgataacaaaaccgagaattacagggggaatataaagccggaatttaatcatttttattttcctggtgattcggatgatgcgtcatacatcgcgcataaacactcatcaatcatccagtcgtcttcccagatctgatactgtgtgccctgttcgggctgcttaagcgggttctcaatcgcctgccgcgcgcgttctttcaggatggattgattgttgaaggcccaggcattgatttgggcggtaatggctttatcgatatcgtcctggttatctctgatataaccgtcacgatacgtattcaataaacaggcaagagacgctgccgaccaaaatccgggaactgaaataatggcatcaagcaatggcgaaagagcgatatcggcacggaaaaacatttccagcttgtactgtaattcgacagcctcatccccggatacccaatcagtcatatactggcaagcaaattgctgcaatatttcccgttcatcctcacgccagttttctttactggcaaggtttatacgccgtagagaaaatacttcgtgaatattgtcaaattgcccctgcgcaacaaactccagtaaacgaggcagaaaataacgaacctcatcgctgttttgcggatcaggtcctggactactattccaggcattgattaaggaataaggaatcgctcgcaacgatgtattccgtaatgctttttgttcctgttgactcagacaatattcacaacaaaccacaaattgcttcggcgccggataacgacgaaaaatatgatatatctgctcaattaatgcctgcatggcaggagtggggggcataattaccccctcgcccgctgatcgcgtgtaaagggttgatagacaaaacgagcattcgccgcattcaggcgaataatggcactacgagagagggaaaagctgggccgaatgcaataattacagtcccaacagctttcctctgtgcaattttccactgagtaatgacgcgcgtagagtttcagttcagcctgcttatcgcgaaatccgcgtaaactgttatcgttttgaaattgccaggcttctttaaacacttgaaagatataaacatcctcaatccaggcgtcacattttttaagcgggcgctttgctatgatcacccgctcatccgggttgagcatcgccgtaaattgtacggtgaagtcatttgttgtgttcagatcacattgaacatctggtacatcactgatatagagggcaaatccaaagtcagcaccacaggcacaaagacggctaatggtggcggtatcgagggaaaatcccggccatacattgctggacgttaaaccaatatttaatgtgacatcgtatcgagataatccctcaagaccggcagcaccggcgaacttttccccttcatccaggacctggttaatgagttgctgaacaatgccttcatcccagtatgttgatttgcagtgggcaatcgtaatatccacgccagtgaatggatcagtaccggagaagtttgcaaataacgtatcaactaactccatttttattatccggcttaatgcaacattttattcatcggcacataacctacattttctaccaggttttgcccctgtagaattaaaaatattttttattttacattctgttcatccctattattgcattttattttgcggtgatggctaaaccgattcggtactggctcaaaaattactgatattccactcgcaatatagccagtgcattataacgacctgccgcaggcacttttccagttgtactaacaggtaaagtcaggaaagtaacatcagcagtttgcgcagaagccgtctggttttccaccaatctgaatggaacgcctactgatgttgccagagcatttaaatctacggagttttgctgactatccataatcataataccaacatcaggattatcttgtgcctgaataatactttgtttcccattggtatcacgtgtagctgaaatgttaccgtcgaataccaacgtcattaccgcatctgtatctttattcgtacaattaatcggaatagtggttgctacaggagtaacaccagcgggcttcgctccggcaccagcccggctcaattcactggcccacacatccggcatattaacagtaaaactcgtacctcattaattgtgcaaccttgcggaacctgaatatccaggttgctgatccaggcattaaataatggtactggcccatgttccgtttgccgctgactggcatacaatgaaactaaaagtacattattcagagagatatcagagataatctttttatccaatttaattttaatatagccctctgttcctgaagaccaatttgatggtttacttctatccgttggataattagtactataattataaaatggtactgttttatctgtctgtgtcccatttttattatagagtttaacatgtgtagaaattgatatttcatgcgtcactggaacaaatatatcactcccctgttgaataccagatgtaccagatggatcaatacctgacactccgctaaaatatacctcataattgctaatggaattacaataagccttatacagaccaattttccagtttttttcgggcagaatagtacctggtatattattatttatatctgaaataatcgttgtgccaaaattataataaaaaacagccggtgtggtattgttttctggagatccaggatagcaaaactcacgatcccggcccatttcagcataggctacaacatggtaacccaagaataaaaagattataaaaataactttcagcttatatccggtataagtaatcatattatttccttttactaatccgttttaacttgtaaacctgacacatccatctgcaacagattcatctttactttccatgcaggtaaaacattattataaacatccaatgtctgccatgctatttcacaaaccccttgcgatttacaccatgattgttggcgatggctaaatggtgcgaccataccaccatctataactttaccatcaacatgtaggttatagagtgtcacatatctggggcctggattataaacggtaacaatttcattttttcgtgcccagcgtaatttctgatatgacatattcgggtcttcagacaaatttgatggccgatagaatattttcatacgattgcggactgctatttgcaattgattatcagttttgactgaatgactattttccaacgttggtaatgctgcaacattcagtataaataaactttcccggtcggcagataaactgccaccaacacgattaattcttatttttgtatttttgtcaggcttcaaaacaaacagtggcggagttgcgataaataccgtttcagaatatgagggcaaagattcaaccgttcccgtcaactgacgagcatcatcaggggagacagcaaccttgactaacatatctctgtctgaagtgtttttgagttcaacagatattgaggactgattttccggatacgcaaaacgcgttccaccgatcactaagcctgcttgtgctgtagagaataaaagggaaaataatactatgactaccttaatcataggtgacaataaacgatactgacgcatttgcatcccctggttggacattattttttaatgctttgtaagccgcaaaaaaatgcaatatattatcaactgatgatgtaagtgaaaaacccatgcttttaacatcattactaatactgcctttgttcttatcaaaaatcgtaagtgcaagcccctctaccgagccatcttccagcttatataaactggcatcttcagaaactgtattgccggtaaactttatatacgcgttgccaacatcactaccacagcgggttaacgttatggaaaaataaaccttttcagtaacatcccctgcactccttaccgaactactgggtacgtctggcatattaactgtaaaattttttgactcatcagaaataatgcaggttttttcggtaattaacccttcaatacgaaccactccggcatgagtgatatcatcagcaaaagaatttgttgatattataaacaaaaataaactaatgaatatcttcatatctccctcactgataatcgatatcaaaatacaacagagcatttgcttgcccggcatgtacattttcctgagttgatttatagcgaagtttaaacgtcaaattagcatcaccgttttcatttaacactaaatcacgaaaacctgattcaccattaatggcaatcgccacatcattgttatccaatatttctattcccagtccagtcgcactatctgcaccggcggagagacgcagtaatgcgctattaatggcatctgcatcaccagtaaaccgcacattggcgctcacaccagaactataaacagtactttttgcagtcgggcatccttgtacattaatcgtaaacgtttgactcggagaaacatcacctacatttaaaaattcattagcatcataagtgcccatttttaccgactgatctttacttccggtagtaatgtcacagctttttgccaacaaaatcccagtaaatgtaacaacaactgaatcattggcctgccctgagagcggaaaagcaaaaaaagcgaaaagaataaaaaatacagaatatttagagaatattaaattcattagcggcactccagagttgcatagctaacaggattatccagttctgtttcagggagcttgtaattagcctgacatttttgctgaacaccgtctccccactggatattaataacaccttctaaaggcaatcctgagagataaagttgtccattatcgccgacaatcccggtaatttgactactgtttttaatctgagcgctggctgtagcaccgaatgggactgatttattacgataacgaactgtgaacaaaccacgaataccgatatgagcagcaaactctgcacgaactaacgcaccttttcccggaataacttcagtggaagtgatatccagttcagtatgcatattcattgacataggatctaatgaaatattattacgtctatattctgttgcataaggaacaactgcatatccacgccagtcagtggatattcctgtcccccgctgaacatccacattattcgctccaggcgcttttatcaaaacattagtttcacctaatggttgactcaacgtaagaccattttcatgtacaacaagagcaccactgatgccatagtttatttgttgattaccttcattatcgtaactgtaggcggaattcaaggaaccatatgccccacgataattaacaccaacagaaccactactgctattatcctgattagcaaaaccatgttgtatgttataactgagattatgctgctccaacagagaaccagatacccccgtatattggtttacctgtccgtggttatcctgactataaccatacgttgcagtcatggcattcgatgatgagcgcccatcattcgtggaagataaccaattacttataggtaatgagacatttagcgagacaattttatccgcatttgtccctggtgatttactgtaattccacgcaacatttagatagatacccttaatactggtgttataaccaacttggtataaagaatcttttttatcagtattccagtatgtttgctgactagccgataaatacatagacccgtagttaccgaaaggttgcgatacactagcctgaaattttccacgtttgctataacgcaagttataaaaatcattccagttataaacgtaatctttatcatctaacgtttttggatcaacaacagtccctgacatttgttggtatgtcgtatcacttaaagtgtaaaagccctgggttgaataacgatagccaataatatggaatgctgttcctgtctgaactaacgatttggaataaagaaaacgataagattgcccttgatgtttgctcccatccacaagcgaactgttagcctgagtaacatcaaacgatgttgcaccaaatacacccagattcaggccaaggccgagcgccaacgcccggtaatcctcagagaattgtgccccaccataagccgtaatatcccagggtaaaccccaaattaattccccctgaaatatataaggacttttctggttatagctattgcttcgatattggccaaccgtagtagaatattttgaatgaccttctcgttgcaggatggggacagcggcataaggtacggtatagacagtttctgaattatcagactctttgatggtaacttccagatctcccgcagatgatgtcgggttaagatcgctaatctcaaacggtcccggcggcatataggtttgataaatgacataaccattctgtttgattgttacctgagcgcgacttttcgcaattccgcgcaccgtgggagcgaaaccactttgactatcgggcaacatattttcgtcagattccagttttatgccacgaatactaacactgtcgaaaacatctgatgatgaccatgtatctcctagcgttaattcacttctgaaaggaataataacgcgctgcaacgtactactgatatgctccagtttacctgctgaattactcccacgactccaggttgaataatcgcgaaaacgccatgcaccaatattgatcccagcgcgaagatttaaataatagttatttgaagagtaatcaccacgatcgttattaccagaaaagtcataattcagcaaaaaagctgtaataccgttatcccactgttctggtggaatatatccgcgggcgtcacgttttattatcgcctgcggaaaggtcagtttaagtctctgtgcatccagctccggcatgtaatgcacatcaggaaaccagatacgcaaatcaaggcaactattttcagatgaagccaaagcctgctctggcagcgcatttttgttaattccaaggcttaataagtcagcaagtgaaaggcagggaatcagttgattcgcatcgtctgctttaaaagttacagtacgagagagtaaaggggaatcattgacccaaacttcgacttcatagctaccaggaagataagtcatccctttctcgaagcgggataagtcagcaacagcttcagtatcacccgacagaaaagcagggttaaagcgcattcccgcgattgaacatgcaggcataataaccagaagaagcggcacaacccgtttcatctgcttttgtgccgccatccaatattcgcatcttttgagctttaggttcatatccctgacctgtgttgcatctgaactattccgttgttactgcattattcctttctgccgctccgtcgtagcgccaaagtcattaattgtttgataagtaatttcaccagccaacgtcactggcgacgagaccgtaatatcacttttcggtggtacaaacatattgggcaatttactcccttgtactttaattcctgtcagtgtcaggtaataaggcgaaggattgataacttttagttgttttccctcatacttaaaccgcaacatatttcgtgcttttcctggttgcacaggtagattttccgggcgataaaatagcttgattttgttttgtaatgccaactgtaaggtattcttctgtgtatttttctcatctgttggcggaattgctttaacattcatccaatacaaagtttcacgatcggtcggcaaattagtcttaccaagaaacatgatacgtaatgaagcttctttacgcgttggcaacataaagaggggaggagtgataacaaaatcctggctctttttttccgttttactgtcatcaacccatgattgaattaaataactggtgttgtcaccgctattttgcacactgagtgttatttgcttactttctgccggataaatcaatcgcgttacgccaaggccaaacccgcccgcggacgcattattaataaataatatcgatagtaaaaaaagaatccctgagcgtataatattttgtgatacttttaattcatccctgaatccacaaacccattttttatttccaataatacatttcatacagcatccttgttgatgaaataacatctgttattcatactctattaaataatttcaatctcaggttacaactttttgtaacctgaaatcgtatttatatttactcgtacagcacaacaaaacttgctgttgacttaactacacctggtgcaacagtgctaccgttttgagcataacctgcagtaaaggccgcgctgaaatcatgggtcgtagcatttcctggaattgtataagcggcggtggaggcgctaccctctgccgcagtggtattcaggttaatcagaccattattcgtcgtacctttggagtaaattcgaatccctacaccagtcgcccccgcattgccgctgttgtcagcatccgttgatccttctacttcgttagcgagcgttttattagcgctatctgcagtaccggtaaaacggaactcaattttctgatcatctgtattgctacattcggtcagattaatattgaaatcggtctggttgctcgccccctgtgcttctacgtcgataccagtgaaaaggttggaaggcacaaccggcaggacaacttcaatctgttttgaatcggttgcgaccttacaggtagctttcactacacggccagtaaagcggattttcccccccattgaatcaacgttgtcatccatatcagtgagcctgggataatcaacggtgctccagtcagtatccgccccaccaaattgtgttgcatcgccgggtgctgcggttaccgcagtagacatcagcatacctgatgccagtaatactgcggataaattagataaattgaatttcatttatacctttccttttgttaaaaaacccaagcaacattggtgtttttacattctgcgttaataagttatatctcacaaaaaaaataagctgacgttggctaattccagaaggttctttagaagagtaattgagtgaataatattatatatgctgcttagtaatgtacctaaaataatccaaagccgcaataagtgagtttatactcacatataacacactgataatgataaaatttatttttacgtggagttgtaagaggggcaataaaacataaatcacatgaataatattaatgcattcataataaattaatattatttgaaataacaaaataccaaaaacattatcatcaatcgttatttaatatatattaatggtatatattaaatagaataacatacatcaaagttattgtttattgtgtatagaaataccgtgagttccactctgtattacttcagcggaacacacggtatttagccgtatttgaacttacaatctcaccggatcaatatgccagatatgatcggcgtactctttgatcgtacggtcagaagagaagtagcccatattggcaatgttcagcatcgcttttgcggtccactcttcctgacgctcgtagagttcgtcgactttatcctgacaatcgacataactgcgataatccgccagtacctggtagtgatcgccgaagttgatcagcgaatcaaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaagataaagatattgtcagcaccgacatgatccagcatctcgacattcgcaccgtccagcgtaccgatagtcagcgcgccgttaagcgcaaacttcatgttactggtgccggaagcttccgtccccgccagcgaaatctgttcagacagatcggccgccggaatgatcaactgcgccaggctaacactgtagttcgggatgaacacgactttcagcttgtcgccaatctgcggatcgttgttgatcactttcgctacgtcattgatcaaatgaataatgtgcttcgccatgtaataggccgaagccgccttaccgccaaaaatattcacgcgcggtacccacttcgcatccgggtcggccttgatgcggttatagcgggtgatcacgtgcaacacattcatcaattgacgtttgtattcgtgaatacgtttgatttgcacatcgaacagcgctttcggatttaccaccacattcagctgctgggcgatatactccgccagacgctttttgttctccagcttcgcctgatgcaccgcgtgattaaccattgggaaatcacagtgttgttgcagatcattaagcaggctaaggtcggtgcgccagttgcggcccaggtgttcgtccaacacggctgaaagcgatgggttcgctaccgccagccagcgacgcggcgtcacaccgttggtgacgttggtgaaacgacccgggaagattttcgcaaagtcggcaaatagcgattgcaccatcaggttagagtgcagctccgatacaccgttaactttgtggctcaccacaaccgccagccaggccatacgcacacgacgaccgttggattcatcaatgatcgacgcccgtcccagcagatcggtatcgttcggatactgttcctgcaaggttttcaggaaatagtcgttgatttcaaagatgatctgcaggtgacgcggcagaattttacccagcatatcgactggccaggtttccagcgcctcgctcattagcgtgtggttggtgtaggagaagacctgacaacacacttcaaacgcgtcgtcccagctaaattggtgctcatcgatcagcagacgcatcatctcaggaatcgacagcaccggatgagtatcgttgaggtgaatcgcaattttatccgccaggttatcgtaggttttatgcaactgataatggcggcttaaaatgtcctgaatggtcgaggaaaccaggaagtattcctgacgcagtcgtagctcacgcccggagtaggtggagtcgtccggatacagtacgcgagatacgttctcggagtggtttttatcttccactgccgcgaagtagtcgccctggttgaatttaccgaggttaatttcgctactggcttgggcactccacaaacgcaacgtgttggtcgcgtcggtgtcgtaacctgggattatctgatcgtaagctactcccagaatctcttcggtttcaatccagcgcgtttttttaccttcctgctgaatgcgaccgccaaaacggactttatagcgcgtgttgtggcgtttgaattcccacgggttaccgtattccagccagtagtcaggcgactctttctggctaccgttaacgatgttctgcttgaacataccgtagtcatagcggatgccgtaaccgcgccccggcaaccctaacgtcgccagagaatcgaggaagcaagccgccagacggcccaggccaccgttaccgaggcccgggtcattttcttcatcaatcagctcttcgagatttaatcccatcgcttccagtgcgccctgtacatcttcgtaaattcctagcgacaacatggcgttggaaagcgtacggccaatcaaaaactccatcgacaggtagtaaacctgacgagtttcttgcgacaactgggcacggtttgagcgtaaccagcgctccacgagacgatcgcgcacagcaaataacgttgcgttcagccattcatgtttattggcgacgaccggatccttgccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgtcgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctggccggggtattccgctgccgccgcaaggaaaccttcctgcagcaccggatcgcccgcgccgagtagcgccagctgcccgccctgctccagaagaccaggtaaggcttccagcaccaggtcgagacctttctggctggtaagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctctggactccagattttctcgtccacgccgttcagtacgccggaaagacgcccttcacggtgacgctgttgcaacagaccttccataccgtaggcaaactgcggttcggtgatctcgcgagcgtaggttgggctgactgccgtaatgtgatcggcatagtacagaccggccttcaggaaagagatttgtccgttgaattccagcccatgaatattaaagaatgaccatggcaattggatgtcattcatgtgatgtgcataaaacatgccttgataggccaggttgtgcacagtaaacaccgacttcgccggacgcccgcgcgccgccagatacgcaggcgcaaggcctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtatatgccaaccccgttgtaatgaccgaacaaaagcgtgatatgtccggcgaaggtatcacgacgggatactacctgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacaaccgccggataccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcgcgatcgtcttcttccagcagttcatacagatagtcggcgtcaaagacgtaaatacccatactcgccagagatttgcctggatcgttcggcattgacggcgggttagctggtttttcaacgaattcgataattttatcgttctcatcaaccgccataacgccaaacgcggaggcttcttcaatcggtactggcatacaagcaacggtgcaacgtgcacctttttcgacgtggtcgataagcatacgcgagtagtcttgcttgtagatatggtcgcccgccaggatcaccacgtattccgctttataacggcggataatgtcgaggttttgggtgaccgcatctgcggtgccgcgataccagttttcccctttcattctctgctgtgctggcagcagatcgacaaactcgttcatttcttcattgaagaatgaccagccgcgctggatgtgctgcaccagagtgtgggactggtactgggtgatcacgcccatacgacggatcccggagttgatgcagttagacagcgcaaagtcgataatgcggaacttaccaccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcaggtccctgccagacagccgtaatcactgggttatcctctccagcgaatgggggaatggcgtgccactccccagcaggtaaaacaatctctgttacctcaagcgtggcgttaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccatcaaagcgggaatgcgcttgcgcagatggattaacgcggcggtaaatgcggttaaaccactgcttgcctgcgaccagtccaaccaggttaattggttatcctgacagtaggcattgttattgccacgctggctgtgaccatgttcgtcaccggccagtaacatcggcgtaccctgggagagcaacaacgttgttaacagggcgtgaatgctgtcgcgccgccgttcaaccagatcaagagtaccgcctaacccttctttaccatgattgttactgtaattgttgttggtcccgtcgcgattttcttctccgtttgcttcattgtgtttatggttgaagcaaacgcagtcgcgaagcgtaaaaccgtcatgcgcggtgacgagattaatcgcggcactcggcagacgaccattacgtttaaaaacatcgctggaggcagcaaaacgcccggcaaacgctcccagaggtaaatcataatgcagccagaaacgacgggctgcatcgcggaaatgatcgttccactcggcaaacagcggcgggaaatttcccacctgataaccaccaggagcgatatcccacggttcagcaattaacttcacctgcgagagcaccgggcagttctggatagcggtaaacaacggcgcatcctgacgaaactctggcgtacggcccatgactgccgccagatcaaagcggaaaccatcgacgtggcaggtttctacccaataacgcaggcaggcgctggcataatctaccaccgccggatgactcaaattgagcgtgttaccacaaccggtccagttgtgataatcgccgtcttctcttatccaataatagctacggttgtcgatcccacgcagcgagaataacgggccgtcgaggtccagttccgcactatggttgagcacgatatcaagaatgacttcgatacccgctttatgcagtgctttgattgcatcgcgaaactcatccagcgccgtttctggcgagcaggcatacgccggatgcagcgcaaacatcgccaccgggttgtacccccagtagttactaagccccatgcgttgcagacgtggttcgctggcaaattgtgccaccggcagcaactccagcgcggtaatgcccaactgtttcaaatagttgatcatcaccggatgccccagggctttataagtgccacggatctcgaccgggatctccgggtgcagatacgttaatcctttgacatgggcttcataaatgatggtgcagccccacggcatgcgcggcggggcatcatcctcccagtcatagtgatcaaccaccactacgcatttcggcgcaatggaggcgttgtcgcgatagtcaggttcattatgaccggcgtgcagcagcgggttatctttaaactccccgtcaatttgccgcgcgcaaggatcaatcaacaacttcgccgggttaaagcgatgcccctcggcgggttgccaggggccatgaacgcgataaccataacgcaaacccgggcgcgcatccggcagataaccgtgccaaatgtcgccactgtgccctggcaagtcatagcgatgttcctggccattggcatcaaagacacacagctctacccgctcggcatgagcggagaaaagtgtgaagttgacgccctgaccgtcgtaatgcgcgccgaggggagtgggtttgccaatggcgagttgtgtcattctgcctcccgaaccagccagatagtggccagaggtggtagcgtcaggctcagtgaatgctgacgaccgtggctggcaatctcatcgctgtgtactgcgccgccattgcctgcattactgccgtgatagtgcatggaatcggtattgaggatttcacgccatttacccggctggttaataccgaagcgataatcatgacgcggcaccggtgtaaagttactggcaacgatgatttcgttaccctctttatcgcgacgcacaaagatcagcaccgagcgttctttgtcatccaccaccagccattcaaagccgtacgggtcaaaatccagttcatgcattgctttatggtggcggtaggtgtggttcagatcgcgcaccagacgctggacaccgtggtgccagttatcgccgccttccaacagatgccagtcgaggctggcgtcatggttccactcgcggccctgggcaaattcgttccccatgaacagtagtttcttgcccgggaatgcccacatccagccgtagtaggcgcgcaggttagcgaatttctgccatgcgtcgcccggcatccggtcgagaatcgattttttaccgtggaccacttcatcatgcgacaacggcaggacgaagttttcagtgtagttgtagagcatcccgaaggtcagtttatcgtgatgatactgacgataaatcgggtcgagcttcatgtagtccagggtgtcatgcatccagccgaggttccacttgtaccagaagcccagaccgcccatatcctgcggacgagaaacgccagggaaatcggtagactcctccgccattgtcactgcaccggaaacctgctcaccaagaatacggttggtattacgcaagaattcaatcgcttcaagattctcgcgaccgccaaattcgttcgggatccactccccctctttacggctgtagtcgcgataaatcattgacgccaccgcatcgacgcgcagcgcatcaataccaaaacgttcaatccagtaaagtgcgttaccgacaaggaagttactgacttcgcggcgaccatagttgtagatcagcgtgttccagtcctgatgatagccttcgcgcggatcgctgtgttcatacaagttcgtgccatcaaattcggcaagcgcaaagtcatcggtcgggaagtggcctggcacccagtcgagaatcacgttcagaccagctgcgtgtgcggcatcaatgaaataacggaagtcgtcgcgagtaccaaaacggcgggtcggtgcatacaggccggttggctgataaccccaactgccatcgaagggatgctcgttaataggcagtagctcgagatgggtaaagcccatccatttagcataaggcaccagttgatcggccagctcgcggtagctcaaccagaaattgttgtcggtgtggcgacgccaggagccaaggtgaacttcataaatagagattggcgcatcaaactgattcgcttttttgcgctcttcagtctgcacaaccttttccggcaggccgcaaataagagacgcggtttccgggcgcatttgcgcttcgaaggcataagggtcggacttcaggcgcaagttgccattggcatcaatcatctcgtatttatagagctgaccgttatgcgccccggggataaacagttcccagattccgctctctttacgcagtcgcatcggatgacggcgaccgtcccagtagttgaattgcccaaccaccgagacccgacgggcgtttggagcccagacagaaaaacgcgtacctgtgacgccatccatagtatctgcatgcgcgcctaaggtttcatacggacgtaggtgagtaccttcagataatagccaggcatccatttcctggattagcgggccaaaacggtaaggatcatcaatcaggttttgctgaccatgccagacaacagccaactgatagcggaaaaaattcttacgtcgcggaatgacaccgctaaagaatccccgtgagtcgagacactccagttttgcgagtttgcgcccggttttcggttcaatcacccacacatcggtagcgtcgggtaaaagggcacggacttccagtcccgcggtggttttatgcatccccagtacggaaaaaggatccgcaaaatggcctgcaattagcgcgttaatcacgtctctatcgatacgatcggacatgcttgtcttcctgttttattgtgtcaccccatccaactgaatttttgacttctggttgtgacatttttttgacctgaacggcgcagcactctgtgcatcctctctgcgtcgtcctcacttcaggtaaggctgtgaatactcgtgtattccgccacccttaaagaatagccaatgctctatttaactcccggtaaatcatgaaacatctgcgcttactcctgtattacgcactagcaggggcggcatcgcgccccagatttaatgaataaagattacgccagttgacgaagcatccgacgcagcggctccgcggccccccacagcagctggtcgcccacggtaaaggctgacaggaactccggtcccatattcagcttacgcaggcggcctaccggcgtggtcagcgtgccggtaacggcagctggggttagctcacgcatagtgatttcccgatcgttcggaacaactttcgcccacggattgtgcgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcaagctgtttgtcgatccacggaatcaggctacccgccagcggcacgccaaagttatctaccggcagctcaccgctacgggttaaggttgtgactttgcgttcgatatcgagaatagcagaggacgggttcgcgagttcatctgccacatggccatacagatggcccatttgggttaataactcacgcatatgtcgcgcaccaccgccggaagcggcctggtaggttgcaacggacacccaatcaacaagatcattggcgaataaaccccccagcgacatcaacatcaggcttacggtacagttaccgccaacaaaagtcctgataccattatttaatccgtcggtaatgacgtcctgattgacggggtcaagaatgatgatggcgtcatctttcatgcgcagagatgatgctgcgtcaatccagtaaccttgccatccgctttcacgaagctttggatagatttcgttggtataatcgccgccctgacaggtcacaatgatatcgagggcctttagcgcctccagatcaaaggcatcctgaagtgtgccagtggttccgccaaaagacggcgcagcctgaccaagctgagaagtagaaaagaagacagggcgaatggcgtcgaagtcgcgctcttcaaccatgcgttgcatgagaacggagccgaccataccgcgccagccgataaaaccaacatttttcataagcgttttttcctgcaaagatgtgtgctgtataaatgtgccggtctcctcctggcacatctttcaccatacaaaaagcagccaaagtcgcaagtgaaattaatcaatgatagcgaagccatcagtaatgcgacttatcctgctttgttagcacgcagaaagtccgcggcaattatcagggaatttgagttatgaatgaaatcatttctgcaacagttttattgatcctgattatggatccgctcggaaacctacctattttcatgtccgtactgaaacatactgaaccgaaaagacggcgggcaatcatggtgcgagagttgcttattgctctccttgtgatgctggtgttcctgtttgcgggcgagaaaattctggcatttcttagcctgcgggcagaaaccgtctccatttctggcggcatcattctgtttctgatcgccattaagatgattttccccagcgcttcaggaaatagcagcgggcttccggcaggtgaagagccatttatcgtgccgttggcaattccgctggtcgccgggccgactattctcgccacgctgatgttgttgtctcatcagtacccgaatcagatgggacatctggtgattgctctgctgctggcctggggcggcacctttgtcatcctgctacagtcttcgctatttttacgtctgctgggcgagaaaggggtgaacgcacttgaacgcctgatgggattgattctggtgatgatggcaactcagatgttcctcgacggcattcgaatgtggatgaaggggtaacaaggagagtttttcgaaaagagcccggtagcgtcagaactaccgggtaaacaaacttaactcaacagctggaacgcaatcatcccaacgatggcaccgacagtgccgaggatggtttccatcatggtccaggttttaagcgtttcggcttcggtcgcgccggtaaatttaccgaacaaccagaaacccgcgtcgttaacgtggctgacaacaatcgaaccaccggcgatacaaatcgacagcgccgccatttgcgcaccggagtagttcagttgttcaatgaccggcatcaccagtcccaccgccgttaaacaggcaacggtggcagaaccctgaatgatgcgcactgcagctgccagcacgaagcaggtgatggcaatcggcaggcccatgccggttaacgcttcgcccagtgccggaccgacaccagagtcaaccagcacctgtttgaacacgccgcccgcaccaatcaccagcagaatgatccccgccggttgcagcgcgtgaccgcaaatctccatcactttgtcttttggcataccctgacgcattgccagaccgtaaatcgccaccaggcaagcaaccagaatcgcggtaaacggatggccgataaactcaaaccattcgtaagcggtagaaccttctggcacaaaacgcgcggcaatggttttcagccccaccagcaccagtggcaacaggatcagcgacaggctgaatccgaaggacggcattttgccttcgccgagatgcggttcgctgatgtcgtcaggaatatgcaactccacgtagcggctgatgaaattaccccacagcggcccggcaataatcattcccggaattgccgcgcacaggccaatcaggatcatccagccaaagtcggcgttcatctgcgatgccagcagcattggcgctggcccaggcaccaggaacgcagccgctgccgccacgcctgcaaataatgggattaccagcttcaccaggttcgtgccggtgtggcgcgccattgagaaagcaacgctaatcagcagaacaatcgccacttcaaagaacagcggtagcgcacaaaccagccccgcaaggccgatagcataatgcacgcggctgtgaccgaaggatttgagcattttgacggcaatctgatcgaccgcgccggtttcatgtaagatcttaccaaacatggctcccagggcgacaaccaccgccaggaagccgagggtgcctcccatccctttttccatcgtcgctgcgattttatcgagcggcataccagaaaaaaggccagcccccatggacaccaccattaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcaatatccaccaccagtacatcggtttcgtccgcacccggctcctgcagcgtttcaaactgcgtcaccagcatttgggttttaaagaaatggcctttgcgcgctttcaggcggctttcaatcacatcaaaatcgcctttcaggtagatgaaagagagattaggattaccttcacgcagcaagtcgcgatagtgttttttcagtgcagaacagacgatcagcgatactttattggtgcgctgcatagcaaacgcggcgtcgttcagcgcctgcaaccacggtttgcgatcgtcgtcattcagcggttcgccagacgccattttttcgatattgcagcgcggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaattaaaaatgttacgggtaactgttatcggtaacattgtccagccggacaatatcagaagcaatatccatccgtgccttaagtgtataagtgtgagctacttcaaatttgtaggcttaaatagatccgcccggtgacaaggtgaaacctaaatctaacattttcggtatcacagattcgccacgaatacgcgccagcaggcgctcagcgccaatgctgcccatccgctcacgcggcgtcagcacactcgctagccgtggctccatcacctgaccaatgtcatgaccgtggaaaccggcaatcgccatatcgtcaggaactttcaaccccaaacgctgacattcaaacgccgcgccgaccgccaggtcatcattagtacagaacacgccatccagctgcggatattcccgccgcgcctggcgaatcagttcaataccggaagagtaagaagaagattgctcaaccatcacgctatacggcaccaggcctgcatccagcatcgcctgttcgtatcccttctgtttgatgatagtacgttcgtcgaggcgtgcgccgagataggcaatgtgacgatgcccgcgagcaataatggcggtggtcatctggcgtgccgcttcaaagttatcaaaaccgacggcgatatcgaggcacggcgacttactgtccatcaactccaccaccggaatccccgccacttcaatcatctttaaggtacgcggcgtgtgggtacgttcggtgaggatcaggccgtcgatattccatgagagcattgattcgaggcgttcttgctccatttccggtttataaccgtagtgcgccagcatggtttgataaccgtgcgcgtcggtgacgctttcgattccgcgtaatacttccgcgaaaacctggttggtgagagaaggtaacaggacgccaatcgcccggctggtagcgttagagagtatatcgggcgcgcgattgggaatataacccagttcatcaagagcggcggcaatcttgccgcgtagagcgacggaaacctgctccgggttgcgtaaaaaacggctgaccgtcattttggtcacgcctacacggtcagccacatcctgaagtacgggtcttttctttttcatcgtcctgaaggtacaaaagagatagattctcttagtttaacacggacgcatcagaaccttcccgattcctcaggaaggtttgtgagataaatttagactggcggtaaatcgaacagcaggatttcactgtcgctatcagcatggatggaaatcgcctgctcatcccagattgccaggccatcgctggtcgaggctttcacgccgttaatggtgacattgcctttcaccacctggatccagacgcggcgttcagcggcaatctgatgcaccgactgctcatctttcaccagcgcccaacgatacagttccatatcctgatgcactttcaatgaaccatcacgcgcatccggcgaaagcaccagttgtttgccctgcacggcatcgaagcgacgctgttcataacgcggcgtaatgccgttttcttcaggcatgatccagatctgatacagatgcagacgctcggtgctgcttgggttgtactctgagtgacgaatacccgtacccgcactcataatctggaactcgcccgccggaacctgctctttattgcccatgctgtcctgatgctcaacagtaccttccagcacgtaggtcaaaatttccatatctttatgcgggtgagtgccgaagccctgccctgcttcaatcacgtcgtcgttaatcacgcgcagcgcagagaagcccataaaattcggatcgtaatagttggcaaaagagaaagtatgccaggagtccagccagccatgatttgcatgaccgcgttcatttgctttgcgtaagtagatcatttgtattcgccccctgaatgatttcgatgggcttagtgtggacccgatccgcctgggatgatagagggtgaaaattgacccctctgttcaaaaaaattgaactattcgaggggccatcaaacttacctcgcgagagtcactgcggagggagaagattgctcaaaaccgcgttcaaggatttccagattcgtaagaacttcagattccttgacgtaatttggcgcaccgttggtgatggtttgatacaacgcatcataaacgcgcccataatcgcccatctctggcttcatctcttctcttaccgtcacgccctcgtcattgacatactccagcacaccgaccgaatcatccgctgcgaatcctggttcgcccggcataatattagccttcaggctggtttcctgctggtcgataccgtatttaataaacgaacctttcttaccgtgaacgataaatttcggataatcgattttcaccagatggctggttttgacgatggcttttagatcgccataaaacagctgcgcttcaaaggtgtcgtccggattggctttattacgcaggctgcggatgtcataagcgacgtgatccgggcgaccgaacagagaaataatctggtccatcgtatgcacaccaaggccatagaacgcgccatcctgcggcagccccggtttggtttctgccaccgggcggtaatagtcaaaatggctttccacttcgacaatctctcccagcttgccgctttcaatcgcttttttcgctgtcaggaagcaggaatcaaagcgacgattctgatacggcgtaacgatcagccctttgcttttcgccagtgcaaacagctctttcgcctgcgcaattgtcggagtgaacggtttttcgaccagcacatttttcccggcttccagcgcgcgcttcgcgtactcgaagtggctgtccgcgtgggtgcagacgacaaccagcttaacatcgggatcgtttagcacttcgtcgagatcgctggtgaaatggatatgggaataaatgggggcctgttcttccggcttcgcatggcggcgaaaaatatgcgcgacatgccagctatccttgcggttaagtacatacggcagatggtaacgggtggtgcttttgccgaagccaataaaggcgcagttaatgaccatgatttcgtcctttttaaggtggttatttacaccttagcgcaaagcggacgtggttcctactggagtgcgcataacgaacacaagcacttcccgaggataaattgagaacgaaaggtcaaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaatgcatttgactcgcatttgaaagtcaatgatgttgaaagggacatttaccccaaagaggacaaaggaatgagtgagatagtaatacgccacgcagaaacacgcgatcacgaagccatcaggcagattcacgcccagccggaggtgtattacaacacgctacaggtgcctcatccttcagaacaaatgtggctggaacgactcaccgctcgccctggcatcaagcagttagtcgcctgtattgatggaatcgtcgtaggccatctcaccattgacgtgcaacaacgcccacgccgcagtcatgttgccgattttggtatctgtgtcgactctcgctggaagaaccgcggcgtcgccagcgccctgatgcgcgaaatgattgatatgtgcgacaactggttgcgggtagatcgcatcgagctaacggtgttcgtcgataacgcgccagcaattaaggtctataaaaaattcggctttgagattgaagggactggcaaaaagtacgcattacgtaatggtgaatatgtcgatgcgtattatatggcgcgggtgaagtaagatagtgccctttttctgagatggaaaaagggtgtcattcaaaatcggcataccttcctttaatgtatttattttcccaataaatatatgagatttacctcataattacttcctaaagtgtaatattttattttttaatatatacgcctacaatttcctggagtaaataaataacaattaacaagcataatattgccattgataaaatagcatgccataaaaggacttttcagggatgagtaatattgtttatctgacagtaacgggagaacaacaaggaagcatctccgcaggttgtgggactactgaatctataggtaatcgctggcagagcgggcatgaggatgaaatatttacattctcactcttaaatagtattactaatacggggcttggttcacagttccatggtataacattttgtaaattaattgataaaagcactccattatttattaattccattaacaataatgaacaattatttatggaatttgacttctatcgaataaatagatttggtagatgggaaaagtattattatatacaactaagaggcgcttttttatcggctattcatcaccagatctttgaaaaccaactggatacagaaacaataactgttagttatgaatttatcctctgccaacatcttatcactaacaccgagttcagctatttggcactccctgaaaattataaccgcttgtttttaccaaattcaaaaaacaaaacaaataatggtttaaaaacgttaaacagcgaagctgttggcaggctacttgctgctggtggcgtatacaatgggaacattgaaggattcagagatactgcggaaaaactgggtggagatgcaatcaaaggctatgatcaaatactaaatgaaaaaacagcgggcatagcgatagcaacagcatctattcttttaacaaagcgttctaatgttgatacatatacagaaataaatagttacttaggcaaacttagaggccaacaaaaacttcttgatagtatagacataatagaaataatataaattaagagaccttcaaaagacttagctaacttacgaaaggagtttaataaaaatgtaagaaaaaattttcttatcaaacttgcaaaaacctccgaagcatctggaagattcaacgccgaagaccttttaagaatgagaaagggcaatgttcctctaaattataatgtacaccataaactatctctagatgatggtggtactaatgatttggaaaatttagtattaatcgaaaacgaaccatatcataaggtttttactaacatgcaatcacgaatagctaagggaatattagtgggtgaaagcaaaatcactccctgggccattccatctggctcaatttatcctcccatgaaaaatattatggaacccacaaaatgatgactaaaacccaaataaataaattaaaaaaaatgatgaatgatttagactatccatttgaagcaccgctcaaggaatcatttattgaaagtataatccaaataaaatttaattctaactcaactaattgcctggagaagttatgtaatgaagttagtattctctttaataatcaacctgattatcttacttttttaagagcaatggatggattcgaagttaatggattacgattatttagcctctcgattccagaaccttcagttaaaaacctttttgccgtaaatgaattttatagagataatgatgatttcataaatcctgacttacaagaacggttagtgatcgggaatgatagcatttcaatatttacttatgacattaaaagtaacttttttgaaattagagataatattggcacagaaaatatattcagttcgtttagtgatttctcttcattcttaaacgaaatcatggacagttgttcataataataaaaaggtaaccaaaatcattgtaaaccatgccatctttttagagtttaccagcagtaaatttcttgatcgaaatttatcaatacaagctatagaaaaacttacaacggaactacactccttaagtgagatggaccgaagacatgtagtcgctatttaaactgaaatagctaatggcgatgatgatcttagtgacatgttgatttggttagaattttacccgaatcataagattctgatatcttaaatgagcaaatccggttcgacgttctggaaaataaatcacaaaatattagcagatacttattttgtgactataccttatccgatgaactcttttcaaaaccagcatttaataatatctttgacgaagatgaacgcgtctttgctcaatgtataacgcaggaataataatataacgctaaacaataatatttattataattatgattacttatcacgacgcattcgcgaaagcgaacaattaccttgatgatgcaaatctcccggtcgtcattactctacatggacgctttagccagggctggtatttctgtttcgaagcacgagaatttctcgaaactggagatgaggccgcgcgcttagctggtaacgcaccttttattgttgataaaggcagtggtgaaattcattctctgggaacggcaaagccactggaagaatatctacaggattatgaaataaaaaaggctaccttcggcttgccctgacaatacggccctcttcccactaagagggccgctaaccttaataccccgccgttaaatcatccaccgagcgcgggtcggatgcaccgtacagctcaccgtccggcccaatcataatgctttgtgtactgcccatcgcctctttcagcgccactttctgaccttttgcttccagcagcttgatcgtatccgggctaaaccctttttcgacacgcagctcgtccggcaaccactgatggtggaaacgcggcgcattggtcgcttcggcgacgttcattccataatcgatgctattcaccaccatttgcagcacagtggtgataatccggctaccgcctgggcttccggtgaccagccaggttttaccatccttgaccacaatggttggtgacatcgacgacagcgggcgtttattcggcccgacggcgttggcatcaccgcccaccagcccgtaaacgttcggtacgcctggtttggcggagaaatcatccatttggttattaagcagaataccgctctcgcccgcgacaatgcccgtaccgaaggtggtattcagcgtataggtcaccgccacggcgttaccgtctttatccactactgagtaatgggtagtttgattactctcataaggcgcaagcttgccaggacgaatttcgctggatggcttcgctttattgatatcgatttgatcggcaatagatttggcataggctttattggtcagcgcctgccacggtactttgacaaaatccgggtcgccaagatattccgagcggtcggcataggcgtatttctcagcttctgccatgatttgcatcgcgtcggcactgccaaagccgtacttctgcatatcgaagttttccagaatattgaggatttgtacgatatgaataccgccggaagatggcggtggcatggagtaaacctgatacccgcgataatcgccgcttatcggtgtgcgttcgaccgctttatatgccgctaaatcttctttgctgatcaagccaccgtttttctgcatctcctgggcaatctgttccgctatcgtgcctttgtagaattcatccgggccgttttcggcaatcatctccaggctctttgccaggttcgcctgcaccagcttgtcgccctttttcagcggttcgccctctttccagaagatagctttgctgttttcgtggttcggcagcacttcactgccgtaggttttgagatcgtcagccagcgcgtcgttaacgataaaaccatcgcgtgccagtttaaacgccggttgcaccactttattcaacggcatggtgccgtatttatccagcgccaacgagaaacccgctaccgtaccgggtgtgccggaagccagatgcgaagtgagtgattttttgctgtccgggttgccctgatcatcgaggaacatatcgcgggtcgctttggcgggtgccatttcgcggaaatcgatagccgtggtattgccatttttcgagcggatcagcataaaaccaccgccgcccagattccctgcctgcggatgcgttactgccagcgcgtagcccaccgccacggcggcatcaacggcattcccgccctccttgaggatatccacccccacctgagtggcagtagcatctacagacgccaccattccctgcttagcgcgtaccggatgaaagacatcttcctccacaccataagaaacaggtggcgcggctaccgtactaaaacaacttcctgtgagcagagcagcaatggccacccggcgtaaaaacgtcggttttatcatcgttattctccagagattaaggggcaaccccagctaagcctggtatataactctgaattaatcatcgttttgccgggaagcgagtaaacttaaagaatatcttcagaggaggatacgcgatgaaacgacttctgcttttgacggcactcctgccgtttgtcggctttgcacagcccattaatactctgaacaaccctaaccagccgggatatcagatccccagccagcagcggatgcaaactcaaatgcagacgcagcaaatccagcaaaaagggatgctgaaccagcaactgaaaacgcaaacgcagctgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatatgctgccggagaggagaaacggcgacatgctgaatcagcccagcacgccgcagcctgacattccgttgaaaactattgggccgtaaagttcggaccaatcacgtcaatcgcatcggtacagatgcaatccacgccccagcgcagcaactctgccgcgcgctggggtttattgacggtataaaccagaatccgtaatccggcatctttcaactgcatcactcgcgctttatcgagcaacttatgattgagatgaatagagacgcagcccagtcgcgcggtcaattctcgccagtcgtcgcgccattcatcaagcaataaaccacgcggcagttccggtgctgcctgttgcgcggcttctaaagcatcaatctcaaacgatgacagcagcggcggcgtcataccggtccacagttcgcgtgccgccaacgccaccgttttgcccgttaatggtccagtgccagtggtgggtttgatttcgatattcgccatcatcccgtgttcgcggcagcgttccgccacctgcgaaagcaacggcagcggctcacctttaaacgctttgctgtaccaactgcctgcatccacgcgcagtaaatcctgccagttcagctcgcccgcaacgccccagccgttgctggtacgttcgagattgtcgtcatggagcaggaagatctcgccatctttcgataacttcgcgtcaaattcgatcatcttatgaccgtattttgccccgacgtcgattgccgccagggtgttctccggggccagcttaccgccaccacgatgggcgacgatgcggggataaggccagttactcatactcgttgtcctgtttcaccatcaaaaagatgcagctgattttccggcagatgcagccacagcgtgctgcctgccgtcgggcgctcctgatgtgccagtcgcaccaccagcttctgttcgccccaacgtccgtgcgccaggttatctgcgccgaggatctccagcgtgtccatcaccagcggcacaccaccttctgcctgcgagcttagcgctatatgttccgggcgaatgccgagggtcattttacgcccggcatactgacggtagccaccgtttagcggcagcgtaataccaccatccagttcgaaatgcgtaccttcgttattcacgcggccagccagtaggttcatcgccgggctgccgataaaactcgccacaaacaggctggcgggcttttcgtacacttcaactggcgtgccaatctgttcggcgacgccgccgttcatcaccattactcgctgggcgagcgtcatcgcctcaacctgatcgtgggtaacgtagagtgaagtcgttttcaggcgacggtgcagctgttgcagttcaagacgcatctgcacacgcaacttggcatcgaggttagagagcggctcatcaaacaggaacactgccggctcacgcacaatcgcacgccccatcgccacacgctgacgctgaccgccagatagctcacgcgggcggcgcttaagcaggccgtccagctccagaatgcgcgccgcttctttaacacgttcggcaatttgttgcttgcccatgccgcgaattttcagcccccacgccatgttctcctctacgctcatatgcggatagagcgcgtagttctggaacaccatcgcaatcccgcgatctttcggctccatttcggtgacacgcttgcggtcgatccagatatcgcccgtcgttacccgctccagtccggcaaccattcgcaataacgtcgatttcccgcagccagacggcccgaccatcacgataaattcgccatccgccacatcaagggtcagcggtttaatgacctgggttttgccatcccagcttttggttactgcctgtaatttcagtcctgccatcttatttctcactatcgaccaggccgcgcacgaaggcacgctgcatcactaaaacaatcactactggtgggatcagggttaacaacatcgccgccatcaccgagttccattccgttgtgccttcgcctgtggcgatcatccctttaatccctgccacggtggtgccgagatcaacgtcggtaataatcaacaacggccacaaatactggttccagccgtaaataaaggtaatcacaaacagcgccgccagattggttttggacagcggaaaaacgatgtcgcaaaagaaacgcattggcgacgcgccgtcgatccgcgcggcttccaccagttcatccggtagggtcataaagaactggcgaaacagaaacgtggcggtcgccgaggccatcagcggcagcgttaaacctgcgtagctgtcgagcattttcaggttggcgatgacttccaccgtcgggaagatacgcacttcaaccggcaacatcagggtgataaaaatcatccagaagaagaggttacgtagcggaaaacgaaaccagacaatggcaaatgccgagagcatcgagacggtaattttgccgagcgtaatgctgaacgccatcacaaagctgttaagcaacatccgccagaacggcgcgctattcgtgcctaccccgtttacccagatgttgtggatgttttccagcagatgtgtgccggggattagcgtcatcggtgcggcatagacttcttgtttatccagcgtcgccgcgacaaacgccacgtacagcgggaagaggatcaccgcgatcccgaggatcagcatggtatggctgaatattgtcagccacggacggttctcaatcattggtaacgtaccttgctttcaacatagcggaactgcaccaccgtcagcacgatgacgaggaacatcaacaccaccgactgcgcggcagacgaagccaaatccagtccggtaaagccttcacggtaaatcttataaatcagcgtcgtggtggcctgtactggcccgccggacgtggcggcgtcgatcaccgggaaggtgtcgaagaaggcatacaccaggttcaccaccagcaggaagaaactcaccggagcgataagcggcagcgcaatcttaaagaagcggcgaatcggccctgccccatcaatggctgcggcttcgatcaacgaacgggggatggattgcagcgcggcatagaagaacagaaagttgtagctgatttgcttccacactgaggcaaacaccaccaggaacatcgcctgaccgctgttttgcgcgtggttccagtcgtagccgaactcagcgagaaaatgggtgatcagcccgcgaccagggttaaacagaaagatccacaatacggcggcaacggcgggagccacggcatacggcagcagcatcaaggtttgatagaaacgactgccgcgcacgatgtactccaccagcgctgcgaagaacagcgataccagcaaaccgctgacggtgacaaaggtgctgaattttatcgtcgtccagaaggcgtcgagatagtagctgtcgtgaaacagcgtgacgaaattatccaggccgacaaactggctggagaaaccaaacggatcgacgctttgtagcgagtaccacaacgcttcgcccgcaggccagataaaaaagataacggtgatgatgagctgcggcgcgaccagcaaataaggcagccagcgcgagcggaacaccggacgggatgatgacattacaattaattcctgaactgtgccggatgcgcttcgcttatccggcctacacgcgatgccaggtcagataagcgaaacgcatccgacattacactgattaagacttcgtcgatttctcaaagcggcgcagtaactggttcccacgctcaacggcagtatccagcgcctgctgtggtgtcttcttaccggtccacacgctctccagctcttcatccacaatcacgcggatctgcggcatgttgcccagacgcaaacctttggtgaacggcaacggtggcttgttcagcatctgacgcgtggcaatatccgctcctgggtttttctcgtaaaagccctgctcacgggtcaggtcatacgccgctttagtgattggcagatagccggttttctgatgccactcggcagcgttttctggctttgcgaggaagtcgaggaacttcgccacgccggtgtaggtttctttatctttaccctgcattacccatagactggctccgccgataatggcgttttgtggcgcatctttcgcatcggcatcgtaaggcatcatgcctacgccatagttaaatttggcgtactcgcgaatgttggcgagagaaccggaagaggcggtggtcatcgcgcaatcaccgttatagaacttctcggtggattcatccttacgcccaacgtagctgaaatcgcccttcttgttcatctcttcgagcatggcgatgtgtttcacctgctccggcttgttgaactcaagcaccgcgtctgtgccgtcaaagccgttgtttttgctggcaaacggcaaaccgttccaggcgctaaagttttccagttggatccatccctgccagccgctggcgtagccgcacttcataccggaggctttcagttttgcggcatagtccgccagatcctgccaggtttttggcggctgttccgggtctaatcctgctttcttgaaggcgtctttgttgtaatagagaacgggagtcgagctgttgaacggctgggagagtaagtggccggttttgctgtcggagtagtagcctgaaaccgtcggcacaaactgcgactcatcgaattgaatccccgcctctttaaacacgtcatacaccggtttaatggctttcgacgccatcatggtggcggtgccaacttcataaacctgcaaaatagccggagcgttgccggtacgaaatgcggcaatccccgcgcttaaattctgttcgtagttgcctttataggtcggtacaattttgtaatccgggttttcggcgttaaaacgttgggccagagaatccacctctttacccagttccccttccatcgaatgccagaacggaatggtcgtcactgcctgcgcatttgccattaaagccagtccgagcgccagtgctgaagctgtataacgtaacggtttcattgattatctctcttgttgtaccgaatgcgcgaattcacgcgttttatgctcgcggagtaacatgacatgctcgaattacagaaaaataactattttgttacatttttaagatagtaaggtgtcagaaagatgacaaggcggtgacggcgcgggcgagggaaaatgggagatggggcacggataagcggaaaaatagaaggtctgaatcaaactctacagattactcatcgtttcatgccggatgcggcgtaaacgccttatccggcctacaagatcgtgcaaattcaatatattgcaactcacccagtaggcctgataagcgcagcgcatcaggcaattttacatttgtcacctgtctcaaaggagtcttttgactccttatcaatcaacgtgttattacccgcctaaatacgcacttctcaccgcttcattcgccagcagcgcgtcgccggtatcggagagcactacatgaccgttttccagcacgtagccgcgatccgccagctttagcgcctggttggcgttctgctcgacaaggaagatggtcatcccctgctcgcgcagttgttcgatggtgtcgaaaatttgctggatgataatcggtgccagcccgagcgatggctcatcaagcaacaacaaacgcgggttgctcatcagcgcgcgaccaatcgccagcatctgctgttcaccgccagacatagtgcccgctcgctgaacacggcgctcatgcagacgtggaaacagttcatagacccactttatgcgctcctggaactggtcgcgttcggcaaaaaagccgcccatcgccaggttctcttccaccgtcatccgcgagaagacacgacgcccttccgggacaatcgctaccgcttcgcgcatgattttcgccgtctgccagtcggtaatgtctttatcatcaaacacaattcgcccgctggtggcgcgcggatcgccgcataacgtgccgagcaaggtggttttccccgccccgttcgcgccaatgagggtgacaatctcgccctgattgatatgcaggctcacctcatgcagcgcctggattttgccgtagtgggcgctgactttgtcaaaggacaacatgactttttccatcttatgcctcacctaaataggcacggatcacatccgggttattacggatctgctccggtgtaccgtttgccagcggcgtcccctgattgaccacgtaaattctgtctgaaatccccatcaccagcttcatatcatgttcaatcaacaagatagtggtgttgtgatggttacgcagttcggcaatcagctcatccagctctttcgtctctttcgggttaagacctgctgccggttcgtcgagcattaaaatctccggctgcgtcaccatacagcgggcaatctccagacgacgctggtcaccataggccaggttactcgcctgacggttggcatgttccaacaaaccaatgcgctcaagccaggtagcggcgcggtcgagcgcttcgctctgggcgcgacggaaagagggggttttcaacaggccggagaacagcccagttttcagttgctgatgctgtgccaccagcaggttttcaatcaccgtcatttcacggaacagacgtacatgctggaaggtgcgcaccacgcccatgcgggcaatttgctgccccggtaaaccttccaggtgctgatcgcgcagtaaaatggtaccgccggtgggtttatagaatccggtcaggcagttgaagaccgtggtttttccggcaccgttagggccgattaacgagacgatctcctgcgggtacagttcaagattgacgttgttcaccgccagcaggccgccgaagcgcatcatcaggccgttaacagataataatggctgactcatgcctgctctccttttgctgcgccgtttttcagcttgagttgcgggcgcgtcatgggcagcaagccctgcggacgccagatcatcatcagcaccatcaaaccaccgagcattaacatgctgtattcgttgaaatcacgcatcaactcgcgcgataccaccagcaaaacagccgccagaatcactgcaaattgcgagcccataccgccgagcaccactatcgccagcacaaacgccgattcggcaaaagtgaaggattcagggctgacaaagccctggcgcgcagcaaacaacgttccggcaaaaccggcaaacgcagcgctgatggtaaaggcagtcagcttgatacgacgcgggcttaagcccagcgaacgacaagcgatttcatcttcacgcaacgcttcccacgcacgccccagcggcatccgcagcaggcggttaatgacaaacaggcttaacaccaccagcagcaacgccaccaggtagaggaagatgacgcgatcggagggatcgtatttcaggccaaagaaattgctgaacgtgtcccagccgccttcgcgggcggtacggctgaactcgagtccgaagagcgtcggtttcggaatctgactgataccgttcggtccgccggtaatttcggtgttattgagcagcaatatgcgcacaatttcgccgaacccgagggtaacgatcgccagatagtcaccgcgcagacgcagcaccggaaaaccgagcaggaagcccgccgccgccgccatcaacccggcaatcggcagacaggtccagaagcccagaccgtaatagtgattgagcagcgcaaaagtgtaagcgccgatggcgtaaaagccgccgtatcccagcaccagcagaccagaaagaccaacaaccacgttcagcccgagaccgagaataatgtagatcatggtcagagtggcgatatccaccgtcccacgcgacaccataaacggccacgccaccgcaagcaccagcagcgccacgaggaacagtttctgcttcaccgtggagccatcaatcgcgggcagaataaacttcggcccggaaacgctttttagccctttctggaaagcaggtcgcaaaagctggaagaaaaagaccaccgcagtgccgataaacacccactgccaacggatgtctgaagccgtgtcgaccaccagtttggtgccatccagctccagttgcacgcccataaagacgcccgccagcacaaagaacatagcggcagagagcagcgccattgcaatatgcatcggtttcatactttctctacctccgggcgacccagaataccggtcggcatcaccagcagcaccaggatcagcagggcgaatgagaccacatctttatattccgtactcagataggcagaagagagcgcctccgcaatccccaggatcagcccgccaatcatcgcccccggaatgctgccaatcccaccgagcaccgcagcggtaaaggctttcatcccggccataaagccgatgtaagggttaattacgccgtagaactgaccgagcagcacgcccgccactgccgccatcgccgcgccaatcacaaaggtcagcgcaatcacccgatcggtgttgatgccaagcaggctcgccattttcagatcttccgcgcaggcacggcaggctcgccccatacgggaatagcgaatgaaaatcgtcagtgccagcatggcgaggaaggtgacaatccagataaccgcctgcatggtagtaatagaggcagagaagttttcgctatgacccactacccactgaccgttaaacaggctgggcagcgccacgtcgcgcgaaccttcggtcaggctaacgtagttttgcaggaagatagacataccgattgccgagatgagtgcaatcaggcgcttagagttgcgcaccgggcgataggctacccgttcgatactccagccgtaggcgctggcaatgacgattgcgccgacgaatcccgccaccaccagcagccagccggtatcaatgcccagcatcatcagtgcggcgatgatcataaaggagacgtagctgccaatcatgtaaacctcgccgtgggcgaagttgatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgtttttcacgaacggtgggatgatcacttggctgccgtggatgaaccgtcggcatgccactggaagacaccaaaatcgaatcccttaagatcgcctttttcatcccagttcagcggcccaattacggtgtttgcaccgttagcttctaaatctttcaccagcgccagcggctcatcgctgccggtacgttcaagggcagttgccagagattgcaccgccgcgtaggtgatccagacatagggcccggacggatctttcttgtcggctttcagcgcatcaacgatgccctggtttgtcggatcctggtcatagcgttttggcatggtgaccaacatgccttcagcggcatcaccggcaatgttcgacagcgacgcattaccgacaccttccggccccataaactgggttttcaggccaacggaacgggcctggcgcagcatctgccccatttccgggtagtaaccgccgtagtaaacgaagtcgatgttttcttttttcaggcgggcgatcagcgcggagaaatctttctctccagcggtaatgccgtcgaagaagacgacgttggcgttagccgctttcagcccgtcctgcaccgaacgtgccagcccttcgccatactgttgtttgtcgtgaatgatggcgatgcgctggggcttcaccgtctcaagaatgtattttgccgccgttggcccctgggaagagtccagcccggcagtacgcatgatgtattgataaccgcgttgggtcagctccggattggtcgctcccggcgagatcatcagaataccttcgtcttcatagatatctgatgcaggttgggtagaggaggaacacagatgaccaataacatatttaatgccgtcgttaacgattttgttggcgaccgcaacggcttgtttcgggtcgcaggcgtcgtcatattccacgccaaccagtttatcgcccttaattccccctttggcattaatgtctttaattgcctgacgcgcgccgttaaattccatatcgccccactgggcaatcgggccggacatcgcgccgacaacggcgactttaatatcgtcagccatagcggtgtgtgaaattgtcagtgcaatcatccctgcgatgatagttttcgcattccgtttcatagtcaaaaatccccattcgtgatgttgtgttgctttgtttttatgtgttaacaaatcagactgttctttttttatactgcactgtttttacctgtctgattaagggtttagcgcagtattttgtgatgatagcgattaaaatccctatttttcagtcgattaagaacagataatattctgaatttattgatagataaacagaaaaaagtgcctttgtcagcataaaataacggcacaaagggcggaataattcactaccattcaggggattatgctgggtatttttcattctctaatgttttaactttgtaattattgctgttaaaaaattaatcacctgccaaaagaattaaaaaagagaaagcctccgattaaattatttcgctacactggttccacttttgtgatttacacgggttacccatgaagctgaccatcattcgattagaaaactttagcgaccaggaccggattgacctgcaaaagatctggccggagtattccccttcctctttacaggttgacgataaccaccgtatctacgccgcgcgttttaacgagcgccttctcgcggccgtgcgggtaaccttaagcggcaccgagggggcactggattccctgcgtgtgagggaagtcacccgccgtcgcggtgtggggcaatatctgctggaagaggttttgcgtaacaatcctggcgtttcatgttggtggatggcggatgctggcgtggaagatcgcggcgtgatgacggcgtttatgcgagcactgggatttacggcacaacagggtggctgggagaagcgttaatcgtcaagtttgatttcacaagtgatattgcctgatgcgctacgcttatcaggcctacaatgtgtgctgcaatttactgatttctttgaatcttgtaggccggataaggcgtttacgccgcatccggcatgaagcaacgtactcgatattagcaatttggcggcaacccaaagttgccgattaatgattacttcgcatcagtcgccgtgccgttggcgtgccagtcaaacacaccgaactcaaagcctttcagatcgcctttctcatcccaggtcagcggccccatcaccgtatcaaccgagttcgctttcaggtatttagcgatctccgccggatcgtcagactgattcaggcccgcttgcaaagattgcagcgcggcgtaggtggtccagacgaacgcgccgcttgggtcctgttttttcgctttgatcgcgtcaacaatcggtttgttcgccggaacctgatcgtagttcttcggcttggtcaccagcagcccttccgctgattcgcccgcaatgttagacagcgagacgttagccacgccttctggccccataaactgagttttcagccctgccgcgcgtgcctgacgcaggatttgccccatttccgggtgataaccgccgtagtaaacgaaatcgatattctctttcttcaaacgcgccaccagggtagagaaatctttttccccggcggtgatgccatcaaagaacaccacgttagcattgcctttcttcaggccgtcctgcactgcacgcgccagaccttcgccgtactgctgtttgtcgtgaacgatagcaatgcgttgcggtttcactttctcaagtatatatttcgccgccgtcggcccctggtctgagtccaggccggtggtgcgcaggatcagctgatagccacgggcggtcagctctggtgcggttgccgctggggtgatcattaaaatgccttcgtcttcgtagatgtcagacgctggctgcgttgatgaagagcagaggtgaccaatcacgtatttaatgccgtcgttaacgactttgttcgccaccgcaaccgcctgtttcgggtcacaggcatcgtcatattttacgatttgcagtttgttgcctttgataccacctttagcattgatatccgcaaccgcctgctctgcgccagtaaactcctggtcaccgtactgcgccaccggaccggacattgcgcctacgacggcgactttaatatcttctgccagagccatattgctgaatgccagcgcgatacatcctgccagtaacgctttaccctttatgttcatcctgagaatccccactcttctggttattacgtgtgttgtgatgttgttgtgcagcactttatttcgttttatacgtagctacccgtgctttagcagcatactctgctaaaacataccccatttttatgatattggaatagctattttgacagtttattaacaatctgcgggacagttggctttttctacaagaagaaattcacctaaacaagcgttggggtaaaaatagcctggtacatcaaatgatgatgccatcacgcatacctcaaacctgagcacgataaagcttaccgagcaaaatacatcacaattcccgtaatcaaataaacaaagtaatggcaataaacattgctgataactagcctgtactcagttttggaatggacctcccttgagcatttttcctgatatgttgtctggtttcaaatattcctcataccccccaaatgttgctctatagcatttaatctattagtagaaacggctatagctcaattgtgtttttccagattgagcatatcccttttcccatcctgaaatttaaaacaagcattaaatatatataattagcataaagtctatcttctttaagcgtaatacgtcctctttttatatataattcttataaatcataagtgttgatttatttactcgacgtatttttggttcactggaatatattcattaaataaatataaaagtattcaattatcattaattatgatgaacagcacatcataagccctgttttttattacaaacaatttattagcaattttagctaatgctatcaactgtgatcttgctaacattatcgccaaataaaaacaatataatcaaaggccaaaggttaccttgctgaaagctaaaaacattcatgtgttgaatattatttattatctatcctctgtacatattaaaaggaatttatcatttgaaccagttcaatattataattctgacacacggtgaggcagggaatgctttactcgccagtagcgaaatgattgtaggtaaaacaccgcatactacagctatttctctgatgccgggaatgtcacctgaagcacttatgcaacaagtaaaaaccatactcaatcctgatgtagaaacaatcatatttacggatatttatggcggcacaccttcaaatatcgcctaccttctttcacgagaatttcccattcgctgcatcagcggtgtcaatctggcaatgttaattgaagccaacatgttacaggattctgacgaagaacagtcctttgatgaatatattcagcatatacatgatgctggtaaagagatgattcaaacttattgttttaataaaggatgataaactatgagtatagtacatgcccgtattgattaccgtttaattcatggacaagtcataacaaaatggctaaaaaggagtgatgcaaataaaataattgttattgatgatcccttgtcacgcgatcctttcctggctgaagtctataagatggcagcgccaagtggtgttgaagtcataatgacctccattgaagatacgttacaacgctggaacagcaatagtttctatgaaggtaaattactaattcttttcaaatcgatcgattctgcattaaaaactatacaaggtggtttgatgttagaggaattacaagtcggtggtgttgaaaatactccgggaagaaaaattgtctttaaccaaatatcactcaaccacgaagatgccgacaaacttcaaatcatcgaagataagaatatcaaagtttatttccaaactattcctgaagaagatcctgccagcctacaaaaaatcaaaaataagttaccttaattaaggagaggagcttatgtctatttttacagcagcaatgattgccctggtatattggatatcccaagcaaaagtatggtacggcttttctattatgcgtatgccattatcgatagcacctattatgggactcatctttaatgatatgccaactgctttatctgttggggccaccttacagatgatctatatcgggagtattgccccgggaggaaatcctcctgcagatgaaggtctagcctcgtgtatagcaattccaattgcacttaccgcaggtattaaaccagaaattgctatctctttggctattccactgggattgctcggcgttgttctggaaaacgtacgtaaaacactgaataccacatttatccacatggctgatcgctacgcagaaaaaggtgatataaaaggcatccaacgcgcagccacaatatatcctctcctgttagcctttccgatgcgttttgtaccggtattcatcgcctgcctgtatggcccggatgccattgcctcttttgtaaacctgcttcccgcctggtcgacgaatggcctggcaattgccggtaatattctgcctgcactcggttttgcgataaccataattgttatcggtaagaaacaatacatccctctgttcattattggctttttcctcgtgacctattcaggcttgaataccattggcatctctatttttggactctgtgccgtcctcttatatatgcagtcacaaaatacaaaaggaactaaaaatggataatataattgagtcaggatactcagaatcctcccctattacgaaaagagacgttcagattgtttggctaaaatggcacgcgttctctgaaacatcattgaactttgaacgtttacaagcactggcattttgcaatgcaatgacaggcgtattggcgaagctatacccagatgaaaaagatctcgccaaagccttacagcgccatttaaccatgttcaacacacaggctaactggggctcggttatcgctggtattagtattgcactggaggaaaaagccgcccaggaatcagaagaacaacgtgaatcaacaacacaacttgttacgggtttaaaaactggtcttatggggcctgtatcgggtattggtgacacgttagactttggtacattgcgtcccattgttattggtgtctgtatcccgtttgttattcagggatatgttattgctgcacttctccccctgatttaccaggttagttatatgttcttcgccagtcgatttgctcttaatatcggctataaaaaagggaaagagtcaattctggaaatcttgcattccgggagcatacatcgaattatcgaaggtgctggaatgttcgggctgttgatgatgggggcgctttcagcaacgtatgtaaaaattaagacgccattgcatattacaaccggcggtggcaataccattgtcttacaggatatgctagataaaattgtccctaacatgttgccacttattgccgtgttgggtatttatttttacatacaaaaatgtggccctcatttcttacgtattctggtcactattcttgttttgagtcttgcattttctttctttggccttttataaaatgaaaaagataattatcactccccggccttttgtgggtaaaggcaaggtctatattgataagttaaaatccgcaggttatcaagttgaatgtaataacagtggaggtcgatatagcaaggaagaactcatcgagaaaattaaagacgcgaatgccattatcaccggaaacgatcctctgagcagagaagttattgatcaggcaaaaaacctgaaggttatttcaaaatatggcgtagggttagataacatagatgtcgattacgcaaatagtaaagacatcgtggtacataaagctcttaatgctaactctatttctgttgcagaaatgaccattctgatgatgctctccagttcccgaaaatatgttgaaatcgagagtcaggcaagaaatggtaaggacatcaggcttgtcgggtatgagctatatcaaaaaaatctgggattaattggacttggtgcaattggtcaacatgttgctcatattgctcattctatgggaatgacgattactgctcatgatcctcatattgataaaagcaaggttccatcctatatagaacttaaatcacctgatgaaatatatcagtacagcgatgtaatttctctgcatttacctttactggacagtactcgcaatataattaacgactctgtatttgagaaaatgaaatcttcggctattttaatcaatacagccaggggtggattggtcgatgagaaaagtttatataccgcacttagcaatcagaaaattgcttttgccagtgaagatattgaactgagagaacgttcaaaagaactcaccgaacttaaaaattattctattacccctcatgccgcttcatttaccgatgaggccgaccataacacaatgcaaatttctattaaaaacgtattacaggaactggagaaagagtaatgaaagagctcaaagggattattaccgcaatggtaacgcctttcgatgaaacggaaaaaatggatatcactgcggcgaaaaaaatggcgcgctggttagtagataatggtgttcatggtttattcatttgcggaactaatggtgaattccatttgctttccgatgacgaaaaagttgagttaacaaaagccgtcgttgaagaggtcggtaatgaagttaccatttgtgcaggtgctgggtgctgcagcacaaaacaaaccatcgaattgactaaacggttagttgatgcgggtgccgattatatttctgttgtcacgccgtactatctggtaccaaatcaggaagatttataccgtcactattacgatattgcctttagcacaacagcccccatcattctctataacctgccgggccagacaggattaagcatcgaatacgaaacggcaaatcgtttagccgatatcaaaaatatcgtagcgataaaagacagtagcggtaaattcgaagtccagaaacagtatctggaaatcgctaaacataaaaactttaaggtattaaacggctctgactcgttaatgctggatgcatttaaagaaggttctgtggctgctgtcgctgcaacgtcgaatgttctgcctacgattgaagtcgatttatataattacttcatggccggtgaaatggagaaggcgcaggaagagcgtaataaaatggatgcactgcgcatgacgatcaagaaaatgaccgcgcctgcagtaatgaaggaagcattaaacctgatgggtgtgaaggcaggtattacacgtagaccaattcatatgccaaacgacgcgatcgttgaagacatcaaggaaatgttgaaaggctataatttcctgtaaaggacaaatgccggatgtatctcttgtcctacaagatagcgtaaacaaaaacccccggactcaaatccaggggttatctgtggcaacttaacgcgctgcgcgattacgcttcaatagcagcgcgaagttttttcatcgcgttcttttccagctggcgcacacgctcagcggaaacaccgtaacggtcagccagttcctgcaacgtggacttattgtcttcgtccagccagcgcgcgcggatgatatcctggctacgctcgtccagaccttgcatcgcgtcggtcagacggtttgctgcctgctcttcccagttatcatcttcaatgccgtcggcaaagttagatgatttatcctgcagatagagcaccggagccatcggctggctgtcggaatcgtcgtcggaagacaggtcaaaggtcatgtcctgtgctgccatacgtgattccatctcacgtacgtctttactggttacgcccagttcacgggccaccatttcgacttcatcctggttaaaccagcccagacgctgcttggttttacgcaggttaaagaacagtttgcgctgcgctttggtggtcgcaactttgacgatacgccagttacgcagaacgtattcgtggatctctgctttgatccagtggacggcgaaggagaccaggcgcacacccacttccgggttaaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgctttagtggtagcaacaactgtgccagagcttaagagcaacgaggttatcattcactgttttatcagaccgtgattttatccacaagttcaatgcaagcttgtgaataaattacgcacaaaatgtgacatagagatgaaataccgggaagagacaacggggtctctttccctgctacggaacccattgcagggaaagagtataacacgcttttattattccggcgtaaagtggcgtaaatgttgtaccgtggcaagccacgctgccacccaaccaatcatcgagcataccagcagcaatagcaggcattcatcgaacgataagccattgatatcaaacttcgttccgaaaacctgtgccacttctgcaaccgccgatgacaaacgcagtaccagaatttctgacaaaattagtgacaacaatgcgccagaaaatcccagcaatgcgccaccgtacaggaacggacgcaggatgaaaccatccgtcgcaccaatcagtttctgcacgttaatggagtcacggcgagcaaagatactcaggcgcacactgttaccgatgacgaggaacactgccgccaccatcaacacgccgatcatcgcggaaacgcgcccgaccagcccggttaacgccgccagacgggcaaaccagctgtcatccatccgcacttcgtcaatgccgttgatctgggtgatacgatcacgcagcgtattcagtgattccgtcccctgaaaatcgagtttcgggatcaccaccgccactgccggaagcgggttttcttccagcatatccagcgcaccaccaaaaccagaccagttacggaactcgcccagtgcgtcttcacgagaaagataattcactttctctacgccttgctcggcctgtaactgtgccaccacacccgcagcggcgtcatcatccagcgttttttgcagataaacagtgatttgcggtgacggataatactgcgtcgccgcctggttaacgtttttgtacaccatataacagacgctgggcagcgtcagggagatggcgataaccatcaccgttaaaaacgtggcgaacggtttgcttttcagatcctgcaatgcgccgtggaaggcatagcgcacctgttcgttgaaaacgttggttttgcgatttaccggttttggcgaggatttcgcccgttttggcgcgttacgaccgccgtcgccagagccgccgaccgatttacggaagcgatccagacgcccgccaaactgccgaatatgattgattgcatcgcgcttattcatggcccacgcctccatgcaagtgaccatcgctcagggtgagcatgcgataggaacgccgcgagatcaggttgatgtcgtgcgttgccatcaatacggttaccccaacgcggttaaactcttcaaacagacgtaaaatgccttccgacaacgcgtcgtccaggttaccggtcggttcatccgccagcagtaccgcgggcttgttcaccaccgcgcgggcaatgccaacacgctgttgttcaccgccggaaagctgaatagggaagttcttcgctttgtccagtagcccgactttatccagcgccgccgacacccggcgacgaatgtcatcaccgctggcaccggcgataatcagcgggatcgccacgttatcatagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaagccaacggcttcgtggaacagtttggcctggcttaccccattctgcccggtgctggcatcaatagtcagcataacttcatgcggagcttcaacgtcgagtttcttcatcacgcggacgattttcttcaactcttccatcaggtgcgatttgttctgcaggcgtccggcggtatcggcaatcaggacgtcgatgttacgcgctttagcggcctgaatggcgtcgaagataacagaagcggaatccgcaccggtatgctgggcaatcaccggaatattgttgcgctgcccccagacctgaagctgttcaaccgctgccgcacggaaagtatcgcctgccgccagcatcaccgatttaccctgctgctcaaactgacgcgccagcttaccaatcgtcgtggttttacccacaccgttgacgcccaccatcaggatcacgaacggcgttttaccttcaacattcagcggctcatcgactttcgccagaatctcgcccatctcttctttcagcaggccatagagcgcctcggcatcacgaagctgcttgcgggatgcgccttccgtcagattggtgataattttacgagtggtttccacgcccacatcggcgatcaacagctgttcttccagctcttcaaacagatcatcgtcgatttttttaccgcggaacaggctgataaatccggaaccgagattttctttggtttttaacaggctgcgtttcaggcgcgcgaagaaaccttctttggtcggtttttcctgctcctgagcgatttcttccaccggctgctcttcttctgccggagaaaccaccattaccgcctcttctgccacttcggcagccagcgcctgtgcctccggctcttcgtcggtgatttcttctttagccgcttcttcttccgccgcttcgacaatctctacggtttccgcttcggcctgccactcttctggcgaaaccgcttcggcgttgacgtcttccggcaacggcagttcttcacgttcgatagccactggctccggcgtttcttctacgaccgattccggctgtgcaacgacttccgcttcaggctgcgctttttcactttcagcaacctgttcagtaacttccacaacgttggcagcaaaagtttccgcctcggcttcagtatgcgcctgcggctgctcttcaacggcgtgttcagaagccttcacaggctcttgcgcctgaacgatttcttctacaactggttgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccaaatccgcattattggcgggcagtggcgaggccgtaaactcccggttcctgatagtccaggtctgcgccccaccaccgaccgcgtacgcgaaacgttgtttaactggctggctccggtcattgttgacgcccaatgtctggattgcttcgccgggagcggcgcgctggggctggaagcgttatcgcgctacgctgcgggggccacgttgattgagatggatcgtgcggtttctcagcagttaattaagaatctggcgacactaaaagcaggcaatgcacgcgtggtgaacagcaacgcgatgtcattcctggcgcaaaaaggcacaccgcataatatcgtgtttgtcgatccaccgttccgccgtggcttgttagaagagacgataaatttactggaagataacggctggctggctgacgaagccctgatttatgtcgaaagcgaagtcgaaaacggtctgcccactgttccggcaaactggtcattacatcgggaaaaagtggcgggtcaggtggcttatcggctgtatcaacgcgaagcacaaggagaaagtgatgctgattaatattggtcgtttgttaatgctctgtgtttggggatttttaatcctcaacctggtgcatcccttcccacgcccgctgaatattttcgttaacgtggcgctgatttttaccgtgctgatgcatggtatgcagctggcgctattgaaatccactttaccgaaagatggcccgcagatgaccaccgccgaaaaggtgcggattttccttttcggcgtgtttgaactgctggtctggcagaagaaatttaaagttaaaaaataaccttattgttcgcctacaaagctgacaaagcgcgttcctttatagctcagcgtacctttatcacccactgtcagggcgtggtactgctgggcgtcgaggcgaaacgtctgctccattcctccgctttgcggtttgaagcttgcctcatagcgcatactggtgcctgccggagtcacttcctgctggcgcgaacggcgatcgttaatcggtttttcccgcttgttgctcaccaccaccagcttttgctggagcggtgccatatcattatcagctttttcccgtcgttgttgcataaaacgaaacgatgcggcgacgatgattaagccaatgataacaataaagaaaagaggtggtttactcatctttatccctcatcggaaaatgcggaaataagcataccctgccagttatggtgttgtcatccgtccaccctcgccactaaactggaagcaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgctgttgctggcctggcaagcgccgatgttcgacgccattagctatctggtgctggcggggctgtgtgcctcactgctgggcgatacgctaaccctgttgccacgtcaacgtctgatgtacgccatcggcgcgtttttcctctcgcacctgctgtacaccatctatttcgccagtcagatgacgctctccttcttctggcctctgccgttggtgctgctggttctgggcgcgctgttactggcgattatctggacgcgtctggaagagtatcgttggcctatctgcacgtttatcggcatgacgctggtgatggtgtggctggcaggtgaactgtggttcttccgtccgaccgctccggcgctctctgcgtttgtcggcgcttcgttgctgtttatcagtaactttgtctggctgggtagtcactatcgccgacgcttccgtgcggataacgccattgccgcggcctgctactttgctggtcacttcctcatcgtccgctcgctgtatctctgataaaacttgactctggagtcgactccagagtgtatccttcggttaatgagaaaaaacttaaccggaggatgccatgtcgactcctgacaatcacggcaagaaagcccctcaatttgctgcgttcaaaccgctaactacggtacagaacaccaacgactgttgctgcgacggcgcatgttccagcacgccaactctctctgaaaacgtctccggcacccgctatagctggaaagtcagcggtatggactgcgccgcctgtgcgcgcaaagtggaaaatgccgtgcgccagcttgcaggcgtgaatcaggtacaggtgttgttcgccaccgaaaaactggtggtggatgccgacaatgacatccgggcacaagttgaatctgcggtgcaaaaagcgggctattccctgcgcgatgaacaggcctccgacgaaccacaagaatcacgcctgaaagagaatctgccgctgattacgcttatcgtgatgatggcaatcagttgggggctggagcagttcaatcatccgtttggtcaactggcgtttatcgcgaccacgctggttgggctgtacccaattgctcgtcaggcattacggctgatcaaatctggcagctacttcgccattgaaaccttaatgagcatagccgctattggtgcactgtttattggcgcaacggctgaagctgcgatggtgttgctgctgtttttgattggtgaacgactggaaggctgggccgccagccgcgcgcgtcagggcgttagcgcgttaatggcgctgaaaccagaaaccgccacgcgcctgcgtaacggtgagcgtgaagaggtggcgattaacagcctgcgccctggcgatgtgattgaagtcgccgcaggtggacgtttgcctgccgacggtaaactgctctcaccgtttgccagttttgatgaaagcgccctgaccggcgaatccattccggtggagcgcgcaacgggcgataaagtccctgctggtgccaccagcgtagaccgtctggtaacgctggaagtgctgtcagaaccgggtgccagcgccattgaccggattctgaaactgatcgaagaagccgaagagcgtcgcgcacccattgagcggtttatcgaccgtttcagccgtatctatacgcccgcgattatggccgtcgctctgctggtgacgctggtgccaccactgctgtttgccgccagctggcaggagtggatttataaagggctgacgctgctgctgattggctgcccgtgtgcgttagttatctccacgcccgcggcgattacctccgggctggcggcagcagcgcgtcgtggggcgttgattaaaggcggcgcggcgctggagcagctgggtcgtgttacccaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcacaggccattgtgcgcgaagcacaggttgctgaactcgccattcccaccgcccaatcacagcgggcgctggtcgggtctggcattgaagcgcaggttaacggtgagcgcgtgttgatatgcgctgccggaaaacatcctgctgatgcatttgctggtttgattaatgaactggaaagcgccgggcaaacggtagtgctggtagtacgtaatgatgacgtgctgggtgtcattgcgttgcaggataccttgcgcgccgatgctgcaactgctatcagtgaactgaacgcgctgggtgtcaaaggggtgatcctcaccggcgataatccacgcgcagcagcggcaatcgccggggaactggggctggaatttaaagcgggcctcttgccggaagataaagttaaagcggtgaccgagctgaatcaacatgcgccgctggcgatggtcggcgacggtattaacgacgcgccagcgatgaaagctgccgccatcgggattgcaatgggcagtggcacggacgtggccctggaaaccgcagatgcagcattaacccataaccacctgcgcggcctggtgcaaatgattgaactggcacgcgccactcacgccaatatccgccagaacatcaccattgcgctggggctgaaaggcgttttcctcgtcaccacgctgttagggatgaccggactatggctggcagtgctggcagatacgggtgcgacggtgctggtgacggcgaatgcgttacggttattgcgcaggaaataaagaggctatcagtctacggtccaacaatgccggatgcggcgtgaacaccttatccggcctacacagagcatcgaactcgtaggcatgataagacgcgacagcgtcgcatcaggcattgtgcaccgtatcgccagatgcagcttgaacgccttatccggcctacaaaccggtttcaagcagcaacattgagcgcgatcggtcccctcgctcctctggggagagggttagggtgagggcaaaaggcggcatcgaagccaatcttcccccatcaaccgcctttacgaatcaaataacgataaggcagtccatcggtctctttcgcaaccagttcgtgttccataaaggtacaaaacccaggaatatcgcgtgtcgtcgccggatcgtcagcaataatcagcaacgtttcacctggctgcatattgcgcacagttttgcgcaccatcattactggttccgggcagcgcaggccaagcgcgtcgagtgtgtggtcagggctggaaaagagatcggtcattttcttctcatcacataaaaaaacggcgctagtttacgccctgtgagtccgtaagcaaaccaggttaacgattgcgtgaaaattaaccattgcattgtcaacgtaaagcagtatcatgcggcggctcgaaaaaagggtcagcacgttattatgttaaggtaacagacgtgtcgtacgtattgggttccctcaccccaatggttaatcaaaaaggtacaatatgaacgttttctcgcaaacgcaacgctataaggcgttgttctggttatcgttatttcatcttctggtgatcacctccagtaactatctggttcagcttccggtctccatttttggttttcataccacctggggcgcgtttagctttccgtttatctttctcgctactgacctgaccgtgcgtatttttggcgcgccgctggctcgtcgcatcatctttgcggtaatgatccccgcattgctgatctcctacgtcatctcatcgctgttttatatggggtcatggcaaggattcggcgcgctcgcccacttcaacctgtttgtcgcccgtatcgccaccgccagtttcatggcctacgcgctggggcagatcctcgacgtgcacgtttttaaccgcctgcgtcagagtcgtcactggtggctggcaccgacagcgtccacactgttcggtaacgtcagcgacacgctggccttcttcttcattgccttctggcgtagcccggatgcctttatggctgaacactggatggaaatcgcgctggtcgattactgtttcaaagtgttaatcagtatcgttttcttcctgccaatgtatggcgtactactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcagaaagtaacgcgaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagcattatctccgcgaaaggccagacggcgtactcttccgttattctgggtaacgtgggtaatcaactgctaaccatgcaaattacgctgcccgctgacaatcagcaaaaagcacagaccaccgcagaaaacatcattaatacgctggttattcagtaagttttaagatgatgaggcggcctcaggtatttccaccgggggccgtttttttaatcgccacgtcagtaataacgcgattgcaaccagtcccgccgccgccagataaatcaccggaacgcccgcccaactcatcaccagcccagccagtggtccggtcacgccaagcgataaatccataaatacggtgtaagttgccagcgccgccccctgattttgctgcggaaccgcttttaccgccactacgcccaatgcagggaacaccagcgaaaaccccgcccccgccagtaagacgccgattttcgccatccacggcatagtcgccacgccaaccagtagcaggccgattatctcaacgctaaagcaaatcatcgccacgtttaagccgccgatacggttaatgccgttagggaataacaaacgcgtaccgacaaacgcacagctaaacagcgtcagcgcgaaagccgcaccgtcccaacctttagcgtcataaaacagcgtgataaaggtggcgataacgccaaatccggcggaagccagtgccagcgccataccgtacagccagacgcgcccaagcaccgcacgaaacggcagcggtttgcctttactggcttttaccgtcggacgcgggatcgccaacaaaatggctaccagtgccacgcccataatgattaacgctaacgcctgcaatccgccccagtgataaaacacgacacctaacggcgcacccatcgccatcgccccgtaagtgacaataccgttccacgaaatcacccgcccgatatgtagcgaaccaaccacgccaacgccccacagggtcgatcccgttccggcaaaactttgtccaatcccaaggattacgcgccccaggcacagtaataacaggctgatgacgggcagactggcggttaatcctgccgtcagatatcccagaccgctcaaaaagcagccgcataaaccgaagacgacaatctttttgggtcccagcaaatcggcgtaacgtccggcatgaggacggctcagcaaggtggcgaaatattgcaggctgataaccaatcctgcccagaaagcactaaatcccattacatcatggacatagcccggtaatacagcgagcggcaacccgatggtgaggtagctggcgaagttaaacatgacaatggagacaatgcgcaaattcaggcgcaatccgtttagcgcgggttcggctacgggttcgggcatgaggatcaccacatttttacaacagtgtttcatttttaccatgtgctgacgtgaaaaacagcagtaagaatcagaatattgctggcgtgactcccgctacacttaatacaaaaagtcacaaggaagccccaatggaaacccctcaacccgataaaacgggcatgcacattctgctcaagttggcctcgctggtagtgatcctcgcgggcattcacgcagcggcagatatcattgtgcagctattactggcgctgttttttgccatcgttctcaacccgctcgtcacctggtttattcgtcggggggtacaacgccccgttgccattacgattgtggttgtggtgatgctgatcgcactcaccgcgctggtcggcgtactggcggcatcgtttaacgaatttatctctatgctgccgaggtttaataaggagctgacgcgcaaactttttaaattgcaggagatgttgccttttcttaatttgcatatgtcgccggagcgaatactacagcggatggactcggaaaaagtggttaccttcaccacggcgctaatgaccgggctttccggggcaatggcgagcgtgcttttgctggtgatgaccgtagtttttatgctgtttgaagtgcgccacgtcccttacaaaatgcgtttcgcgttgaataatccacagattcacatcgccggactacaccgcgcacttaaaggcgtttcgcattatctggcgttaaagacgctactcagtttatggacaggcataatcgtctggctggggctggagctgatgggggtgcagtttgcgctgatgtgggcagtactggcgtttttgctcaactacgtgcccaatatcggtgcggtaatttccgccgtaccgccaatgattcaggtgctgctgtttaatggtatttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggcagcaaactggcgattctactggggccaggcagaccgaaaagtcggttaccgggatgaggcgacaagtgttacgatacgcactttcattttccattaaacgttggccctgatatgtatcggatagttctggggaaagtttcgaccttaagcgcagctcctctgccaccgggtttacgcgagcaagcaccgcaaggtccacgacgtgaacgctggctggcggggcgtgcattgctttcgcacacgctttccccgctaccggagatcatctatggcgaacaaggcaaacctgcattcgcgccggaaacgccgctatggttcaacttaagccatagcggtgacgatatcgccctgctgttgagcgatgaaggcgaagtcggctgcgatatcgaagtgattcgcccgcgcgccaactggcgctggctggcgaacgccgtattcagccttggggaacatgccgagatggacgccgtgcatcctgatcagcaactggaaatgttctggcgcatctggacgcgcaaagaagccatcgttaaacagcgtggcggcagcgcctggcaaatcgtcagcgtagacagcacctataactcctcgctgtcagtcagccattgtcagctagaaaatttaagcctggcgatctgcacccctaccccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgttctctacactccgccgcactctatttgcgctgctggcttgtgcgtcttttatcgtccatgccgctgcaccagatgaaatcaccaccgcctggccggtgaatgtcgggccactaaacccgcacctttacacgcctaaccaaatgttcgcccagagcatggtttatgaaccgctggtgaaatatcaggcagacggttcggtgatcccgtggctggcaaaaagctggactcattcagaagatggtaaaacctggaccttcaccctgcgtgatgacgtgaaattctccaacggcgaaccgtttgatgcagaggcggcggcagaaaacttccgtgcagtgctcgataaccgtcaacgtcacgcctggctggagctggcaaaccagattgttgatgtcaaagcactcagcaaaaacgagctgcaaatcaccctgaaaagcgcctactatcctttcctgcaagaactggccctgccccgtcctttccgttttatcgcaccctcgcagtttaaaaaccacgaaaccatgaacggaattaaagcgccgattggcaccgggccgtgggttttacaggaatcgaaactgaatcagtacgatgtcttcgtccgtaacgaaaactactggggcgaaaagccagcgattaaaaagatcacctttaacgtgatcccggacccgactacccgcgcggtggcgtttgaaactggcgatatcgacctgctgtacggaaacgaagggttattaccgctcgataccttcgcccgctttagccagaacccggcttaccacactcaactgtcacagccgatcgaaaccgtgatgctggcgctcaataccgccaaagcccccaccaacgagctggcagtacgtgaagctcttaattacgcggtgaacaaaaaatcgctgattgataacgcgttgtatggtacccagcaggtcgccgacaccctgtttgccccttctgtgccctacgccaacctcggcctgaaaccgcgccagtacgatccgcagaaagcgaaagcgttgctggaaaaagccggttggacgctgcctgcaggcaaagacatccgcgagaaaaatggtcagccgctgcgcattgaactgtcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatacgatccacacgccttcctgagttcaatgcgcgtaccgtcgcacgctgacttccaggcacagcaaggtttagccgacaagccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtttcaaaaccggaactgggtaacatcccctacgcgccgatcgccaccgaaatcccgttcgaacagattaaaccggtgaaaccttaatgttgcgttatgtattacgccgctttctgctgctgatcccgatggtgctcgccgcctcggtgatcatttttttgatgctgcgcctcggcaccggcgacccggcgcttgattatttgcgtttatctaacctgccgccgacgccggagatgctggcctctacccgcaccatgctggggctggatcagccgctgtatgtccagtacggcacctggttgtggaaggcgctgcatcttgactttggtatctcattcgccagccaacgcccggtgctggacgatatgctgaatttcctgcccgccacgctggaacttgcaggtgcggcgctggtattaattctgctcacctccgtgccgctcggtatctgggcggcgcgccatcgcgatcgtctgccggatttcgccgtccgtttcatcgcgtttctcggcgtgtcgatgcctaacttctggctggcgtttttactggtgatggcgttttcggtgtatctgcaatggctacccgcgatgggttacggcggctggcagcacatcattttgcctgcggtatccatcgcctttatgtcgctggcgattaacgcgcgtttgctgcgcgccagtatgctgggcgtcgccggtcagcgtcacgtcacctgggcacgactgcgtggtctgagcgacaaacagaccgaacgccgccatattctgcgcaatgcctcgctgccgatgatcactgccgtggggatgcacattggcgaactgattggcgggacgatgattatcgaaaacatctttgcctggccgggcgtcgggcgctatgcggtgtcggcgatttttaaccgtgactatccggtgatccaatgctttacgctgatgatggtggtggtttttgtggtctgtaatttgattgtcgatttgctcaacgccgcgctggacccgcgtattcgtcgtcatgaaggagcgcacgcgtgaactttttcctctcctcccgctggtcggttcgcctggcgctgatcattatcgccctgctggcgctgattgcgctcaccagccagtggtggctgccgtatgaccctcaggctattgatttgccgtcgcgcctgctctcgccggatgcgcagcactggctgggcaccgatcatttagggcgcgatattttctcgcggctgatggcagcgacccgcgtgtcgctcggctcggtaatggcctgcctgctgttggtgctgacattagggctgattattggcggcagcgccgggctgattggcgggcgcgttgatcaggccaccatgcgcgtcgcggatatgtttatgaccttcccaacctcgattctgtcgttctttatggtcggcgtgcttggcaccgggttgaccaacgtaattatcgctatcgccctttcgcactgggcatggtacgcgcgcatggtgcgcagtctggtgatttcactgcgccagcgcgagtttgtgctggcatcacggctttctggcgcgggccatgtgcgggtgtttattgatcatctggcaggtgcggtgatcccctcgctgctggtgctggcgacgctggatatcggtcatatgatgctacacgtcgcggggatgtccttcctcggcctcggcgtgaccgcgccgaccgccgaatggggcgtgatgattaacgatgcacgtcagtatatctggacccagccgctgcaaatgttctggccggggctggcgctgtttatcagcgtgatggcctttaacctggtgggtgacgcactgcgcgatcatctggaccctcatctggtgacggagcacgcacactaatgccacaacagattgagctccgtaatatcgcgctacaggccgcgcagccgctggtgcacggcgtatcgttaaccctgcaacgtgggcgtgtgctggcgttagtcggcggtagtggcagcgggaagtcgctgacctgcgccgcgacgctgggcattctgcctgctggcgttcgccagacggcgggggaaattttggccgatggaaaaccggtttctccctgcgccctgcgcggaatcaaaattgccaccatcatgcagaacccgcgcagtgcctttaatccgctgcacaccatgcacacccacgcgcgtgaaacctgcctggcgctggggaaacccgccgatgacgctacgcttaccgctgccatagaagcggtggggctggaaaacgccgcgcgcgtgctgaagctctacccgttcgagatgagcggcggcatgttgcagcgcatgatgattgcgatggcggtgctgtgcgaatcaccatttatcatcgccgatgaaccgaccaccgatctcgacgtggtagcacaggcgcgcatcctcgatctgctggaaagcattatgcaaaaacaagcaccgggaatgctgctggttacccatgatatgggcgtggtagcgcgtctggcagacgatgtggcggtaatgtctcacggtaagattgttgaacagggcgatgtagaaacgctgtttaacgcccccaaacatgcggtaacgcgcagcctggtttccgctcatctcgccctctacggtatggagctggcatcatgactttacttaacgtctccgacctttcccatcactacgcgcacggtggatttagcggcaaacatcaacaccaggcggtgctgaataacgtttccctggccctgaaaagcggtgaaaccgtcgccctgctggggcgcagcggctgcggaaaaagtaccctcgcgcggctgctggtagggttagagtcgccctcacagggaaatattagctggcgcggcgaaccgttggcgaagctcaatcgcgcgcaacgtaaagcgttccgccgtgatattcaaatggtgtttcaggactccatcagcgccgtgaatccgcgcaaaaccgtgcgcgagatcctgcgtgaaccgatgcgccacctgctatcgctgaaaaaagccgaacaactggcgcgcgccagtgaaatgctgaaggcggtcgatctcgacgacagcgtgctcgacaaacgcccaccgcagttaagcggcggccagctccagcgtgtctgcctggcacgcgcgctggcggtcgaaccgaaactgctgattctggatgaagcggtttcgaaccttgatctcgtgttacaagcgggcgtcattcgcctgctgaaaaagctgcaacaacagtttggcaccgcctgcctgttcatcacccacgacttacgcctggtggaacgcttctgtcagcgggtgatggtgatggacaacggacaaatcgtcgaaacccaggtggtgggagataaattaaccttttcctctgacgccggacgtgtgctacaaaacgcggtattacccgcattccccgtgcgccgtcgcaccacagaaaaggtttaacgcaaatgcaacgagtcaccatcacgcttgatgacgatttactggagacgctggacagcctgagccagcgtcgtggttataacaaccgttccgaggcgatccgcgatattctgcgtagcgccctggcgcaggaagccactcaacaacacggcacacaaggtttcgcggtgctgtcgtatgtgtatgaacacgaaaaacgtgacttagccagccgtattgtctccacccagcatcatcaccacgatctctcggttgctactctgcatgtgcacattaatcacgacgactgtctggaaatcgccgtgttgaaaggtgacatgggcgacgtgcagcattttgccgatgacgtcatcgcccagcgcggcgtgcggcacgggcatttgcagtgcctgccgaaggaagattaacacctcccaacgcgccgttatttcctgacggcgcagtagacttctgccaaatatcgactcacgtcacattttgttgatcacgatttggtcccctaaaatgtgagacgcttcgatcctctttttcgcctgttcacctactatacgcttgaagttgtccatgattgtccatagacaactgtaaatgttcaggtgcgcgccatgaaatcattgagtaagtcgtcacaaataccgctctatcaacaagcggtggagtggataagagaaagtatttataccggggatctggtggaagacgatcgcattccttcggaataccagattatggatatgctggaagtgagccggggaaccgttaaaaaagcggtcgcccaactggtaaaagaaggcgtgttgatacaggtccaggggaagggaacatttgtcaaaaaagagaacgtggcatatccgttaggtgaaggattattgtcattcgcggaatcgctggaaagccagaaaatacattttaccactgaagttattacgtcacggattgaaccggctaatcgttatgtggcagagaaattaagaataacgcccggtcaggatattctttaccttgagcgtttacgttcaattggtgatgaaaaagcgatgctgatagagaaccgtatcaatattgagctatgccccggcatcgtggaaatcgattttaatcaacacaatttatttccaacaatagaaagtttgtcgcaaagaaaaattcgttactcggaaagtcgctatgccgcgcgattaattggtaatgaacgcggtcattttttagatatcagtgaagatgcacccgttttgcatctggagcagttagtctttttctcccgaggattacccgttgagtttggcaacgtctggttaaaaggaaataaatactatcttggcaccgtgctgcaacggcgggaagtgagttaagtacacttttttaagaggaataaaatgcaaggcatacagtttcaggaaaattttattcaacgacttccggcagggttaagcgttgaacagatcatccatcagttagcgcaaccgttggttaccgccgaactggtggtccctgattttgccgatcatgtactggaacgtgaggcgacgtacccaacgggactgcctaccgaaccaccgtgtgtcgccattccgcacacggaccataaacatgtcaggcacaatgcaattgccgtcggtatcctgccggaaccggtagtgtttgccgatatgggcggcgactctgatcccgtacctgtcagggtgatttttttgctcgccttaggcgaaagtaataaacaattaaatgccctgggctggattatggagatgattcaggatacgccctttatgcgcgccctgcttacgatggaaacaacagaaatacacacagcaatcttaaacaaaatgaaagaacgaggtgaaatatgagtcaaaccattttatttgtctgcgccacgggtattgccacatccacggcagtaacagaaaaagtcatggaatattgtaaagagcacggtcttaacgtcaattattcccaaaccaacgttgcctctttacctggaaatactgacggcgtagcactggtagtctcaacgactaaagtgccttatgaactcgacgtcccggtggttaacggcttgccgattattaccggtattggcgaagagaaagtactggcgcaaattgtttcgatccttaaaaagtaattaataataattaatttcaacccactccatcaggcgctaacgcgaggtgcgctctcgcctgaaaaagaggtttattatgaacgatatcgcgcataccctctataatattgtgcaatatatattgggatttggtcccacggtaatgttgccgttggtgttatttattcttgctctcttttttaaagtaaaacccgctaaagccttacgttcgtcattaacggtcggcattggttttgtcggtatttatgccattttcgatattcttaccagcaatgtcgggccagcggcccaggcgatggttgaacgcaccggaattaatttaccggtggtggatttaggctggccgccgctttccgctattacatggggttcgccaattgccccgtttgttattcccctgactattctgattaacgtggcgatgctggcgttaaataaaacccgcaccgttgacgtagatatgtggaactactggcattttgcccttgccggtacgctggtttattacagcaccggcagcctgttctttggtttgctggcagcggcgattgctgcggtggtagtacttaaactcgccgactggtctgcgccactggtacaaaaatactttggcctggaagggatctctttgccgacgctctcttcggtggtgttctttccggtcggtctgttggtcgacaaaatcatcgaccatatccccggcctcaatcgtattcatatcgatccggaaaccgtacagaaaaagtttggcatattcggcgaaccgatgatggttggtactattctgggcattctgctcggcgtaattgccggatacgatttcaaaaaagtcttgctgcttggcatcagcattggcggtgtgatgttcatcctgccacgcatggttcgcattctgatggaaggtttattaccgctgtctgaagccattaaaaagtatctcaatgccaaataccctgaccgtgacgatctctatatcggcctggatatcgccgttgccgtaggtaacccggcgattatctccaccgccctgctgctgacgccaatctcggtctttatcgcgtttgtccttccgggtaatgaagtcctgccgcttggggaccttgccaacctggcggtaatggcgtcgatgattgctttagccagccgtggcaacattttccgcaccgttctggcggcgattccggtgattattgccgatctgtggattgcgactaaaatcgcgccgtttattaccggaatggcgaaagacgttaatttcaaatttgccgaaggctccagcggccaggtctccagtttccttgatggcggtaacccgttccgcttctggctgctggaaatcttcaacggcaatctcatcgccattggtctggtgccggttatcgccctggtactgtatggtattttccgaatgacgcggagcacggtttatgcctgataacagcgcagctatcgttatcgatattggcaccaccaattgcaaagtcacctgcttttcctgcctggacgcaacgacgttgggcgcgcataaattcgtgacggcaaaacagatctccccacagggcaatgtcgatttcgatatcgacgccctctggcaggaggtccgccaggcgatagcgcaactgaacgccgcttcgccgctgccagtcaggcggatcagcattgccagttttggcgagtcaggggtgtttcttgacaaacatggcgagattctgacgccaatgctggcatggtatgaccgtcgcggtgaagagtatctggcaacgcttagcgaggcagacagtgcggcactttatgacatttgcgggttaccactgcacagcaattactctgccttcaaaatgcgttggttgctggagcattatccgctgcgcaatcgtcgcggcctgcgctggctacatgcaccggaagtgctgctctggcggctgactggcgaacagcgaacggatatcaccttagccagccgtacactgtgtctggacgtgcgcaaaggcgaatggtcagcgaaagcggcggcgttgttacacgttccctgttcagcatttgcgccattgttgcagccaggtgagcacgccggatgggtcagtgagtcgctctgcaaaacgcttgggttctcgcaatcggtcagcgtgacgctggccggacatgaccatatggtgggtgcgcgggcgttgcagatgatgccgggcgatatccttaactcgacgggcaccacggaaggcattctgcaactggatacacaaccgacgctggatgaacaggccaaacgtgacaagctggcaaacggctgttactcgcttgccaaccagttcaccctgtttgcttctctgcccgtgggcggtttcgcgctggagtggctgcgtaacacgttccggctaaccgatgaggagatcgccgtgtcgctcaatcgtgggtatgcggattacctggcggggaactggtcgctcgatgacattcccgtttttattccgcatcttcgcggttcgggttcgccctataaaaatcgccatacccgaggattattttatgggcttggcgatacgttaaatatcgatatgttaattgccagcgtctcactgggattaaccatggaatttgccaactgcttcgcctgttttaatgtgcccggcaccagcgcgttaaaagtgataggtccggcaacccataatcccctttggctgcaattaaaggcggatattttacagcgtccggttgaagcaattgcatttaacgaggcggtttctgtcggagcattattaaccgccgcaccggatattccaccgccgcaagtcaccatagcccaacgtttgttaccgaatcgggcgagataccatcaattacagcgttatcagcacaaatggaaaagctggtatcagttgaaattacagcaagaaggcgtgatgccattacatcatcgggaggagcactatgttgagtaaaaccgtggaagtcagaaacagtactggcctgcatgcacgtccggcggcctgtctggcgaaagccgccaaaaaatatagctgtaaagtgacgctgcactatgaaggtaatgatattaatgccaccagcatgatgaatattatgcgcgccggaataaaaggcggaaaaacggtggaaatacgctgcgaaggtgatgatgaaaacgaggcaatacaaactctcactaccttatttcgcgaccgcttcggtgaagctgaataattaactgatattaaaagatgaggttttcaatatgccattagttaatggacggatactgctcgaccgcattcaggaaaaacgggtattagcgggcgcatttaataccaccaatctggagacaacgatttcaattttaaacgccattgagcgttcaggattacccaacttcattcagattgcgcccaccaatgcacaactgtcgggatacgattacatttatgaaatcgtgaaacgtcacgctgataaaatggatgttccggtcagtcttcatcttgatcacgggaaaactcaggaggatgttaaacaggcggtgcgcgcgggctttacctcggtcatgattgacggtgccgcattctcttttgaagagaatatcgctttcacccaggaagctgtcgatttctgtaaatcctatggcgtaccggttgaagcggagctgggggcgattctcggcaaagaagacgatcacgtcagcgaagccgattgcaaaacggaaccggaaaaggtgaagacctttgtcgaacgcaccggttgcgacatgctggcagtttctattggtaacgttcatggcctggacgatataccgcggatcgatatccccctgctgaagcgcattgccgaagtcagcccggtgccgctggttattcacggcggctccggtatcgccccggagatattacgcagtttcgttaattatcgcgtcgctaaagtgaatatcgccagcgatctgcgcaaagcgtttatcaccgcagtcggcaaagcgtatgtgaataatcacaacgaggcgaatctggcacgggtgatggcatcagcaaaaaacgccgtcgaggaagatgtgtatagcaaaatcctgatgatgaatgaggggcatcggttgggtaagtaaatcttcgccggatgcggcgtgacgccttatccggcctacaaaaccactaaaattcaataaattgcaccaatgcgtagaccctataagcttacgcatcgggcaactgtaattacgccattgtcccaattgtcttcctgaatctcagcagtgcgatggtgaaaaacgcgccgccaattgccatcagtgtcaggaactgcggccagacgatttcgaatccggcaccacggtagaggatggcctgcgcgaggctaacaaagtgtgtcgtcggcatggtcagcataatgtcctgcaccatctgcggcatactttcgcgcggcgtggaaccaccggaaagcatttgcagcggcagcagcaccagaatcaccagcagccccagttgcggcattgaacgcgctatcgtccccataaaaatgccgattgacgtggtggcaaacaaactgagcgccacgcccagcataaacagcgggatcgagccttcaatcggtacgcccagcacgcctttcaccatcagcaccagcgataatcccgacaccaccagcaccaccagccccatcgaccagacctttgccatcatgatctcaaacggcgttatcggcatcaccagtaagtgttccaccgtgccgtgttcacgctcgcggatcagtgccgatccggtcaacacaatcgccagcatggtaatgttgttgatgatcgccatcaccccgccaaaccacgcgggatcgaggttcgggttaaagcgcatccgggtttccagcgataccaacggttcgctgttatcacggtagcgcgcgacaaagctgttcacttcaccgttgataatattctggatataaccgttgccagtgaatgcctggctcatgcgcgtggcatcgacgttcacctgaatatccggctggcgtccggcgaggacatcacgctgaaaattaggcggaatatttatcgcgaaggtataacgtccggcgtccagtccggcatccatctcatcggcggtgatcatctccggtggcaaaaaccacgggcgatagaagctgttaacgatccggttcgacaactgcgattgatccatatcggctatggcgatcggcgcgaggttcaacgatcctggcgtaacggtcgctgacgaatacaccgacaccgtaaacgagaagacaatcagcgtcagcatcgctttatcaccgagcagactgcgcaactctttgatacccagattaaaaatattgcgtaaatggcgcatcatccctcctgttttttcagcagcaggatgcttaagcccatcaccagcggtatggctatcagcaacgggataaaaagttgccacaaatcagtcagatccagcgctttcgagaacgttccgcgggcgatagtcagaaaatgactggtgggataaacctcgccgatccaacgtcctggaccttccagcgaagctaccggatcgatcatcccggaaaactgtgtcgccgggatcaacgtgataattgccgtaccgaaaatggcggcaatctggcttttcataaaggtggagatcagcagccccattccggtggcgatgatgatatacagcagcgccgccagggtgagagtcaggaaactgcctttatgcggtacgccaaacacaaacaccgacagggcgcagagcaggaaaaagttcagcatccccagcgcgatgtatggcagctgtttgccaagtaaaaattcgctacgggtggtgggggtcacgtaaaggttgataatcgaccctagctctttttcccgcaccacgctaagggcgcttagcattgacgggatcatcatcagcagaagcgggatcaccgccggaacaatcgccggcaggctttttacgtccgggttatagcgatagcgcgtctcaatattcatcagcccgctttggctggcgggtgtggactgtcggctcgccacatcctgtagccagctctggtgcatggcctgcacgtaaccttttaccgtttcggcgcggctcggcatcgcaccgtcgatccagacaccgagttccacgggcgtaccacgcgcgatatcgcgcccgaaattaggagggatctcaattgccaccgtgatatcgcccgcacgcatccgacgatcaagctcgtcataactggtgagcggcggctgttcgataaagtaacgggaaccggagagattgagcgtccacgcctggctactgacggtttgatcgcggtcaagcaccgcaaagcgcaggttttccacatccatactgatgccataacccattatcagcatcaggatcaccgttcccatcagcgccagcgtcgaacgtaccggatcgcgtcgcagttccagcgcttcgcggcggctgtagctaaacagacggcgcaggctgaatccctgacgtggcgcgtgggtagtgtcatgtaccacaggcggcgcttcggcttcgttgctctgccctgccgcttcctgcaaataagcgataaatgcctcttccagactggcggctccgcgtttctcaaccagttccggcggtgtaccgctggcgagcacttttccagcgtgcatcagtgagatacggtcacaacgttccgcttcgttcataaagtgggtggagatgaagatagtcactttgtcctgacgcgagagatccaccatcaactgccagaacatatccctcgccaccggatcgacgccagaagtcggctcatcgaggattagcatctccgggcgatgaatcaccgccaccgccagcgatagccgctggcgaatgccgagcggcaatgactccggcaatacatcttcgacgtcgttgagcttaaaacgctcgctcatttcagccactcgcgcgggaatttccgcttccgggatatgaaacagacgagcatgtaactccaggttttgccgcacggtgagttcgttatagagcgaaaacgcctgcgacatatagcccacccggcgacgagtatcgatatcttttggatcaaccggctgcccgaacagccacgcctcaccttcgctggcgggcagcaatccggtaagcattttcatggtggtggatttaccgcagccattcgaaccaagaaaaccaaaaatctccccgcgtggaatgcggaaattgacgtgatcaacggcaacgaaggaaccaaaacgcatggtcagatcgcgcgcttcgatggcaatctctgcgttttcaggttgatacggtgggatcactaccgcctgatgcgcctggcgttgcgcttgcggtaacagattaataaatgcttcttccagcgtggcgctttgcgtttgctgtcgcagctcttcggcgctgccagttgccagcacttttccggcattcatcgctaccagccagtcgaagcgttcggcctcttccatgtaggcggtggcgaccagcacgctcatattgctctgccgctggcgaatactgtcgatcagatcccagaactgggcgcgggagagcgggtcaacccccgttgttggctcatcaagaatcaacaattccgggtcgtggattaacgcacagcacagcccaagtttttgcttcatcccaccggagagtttccctgccggacgatcgcgaaacggtgctaatccggtgctggtcagcagctcattaattcgcacttcccgctccgctttgtcgtgaccgaacaggcgggcgaaaaaatcgacgttttcatacaccgacaaggtgtggtagagatttttgcccagcccctgcggcatccaggcgatgcgcgggcagacgtcgcggcgatgcttcgggtcgcgcatatcgccgcccagcaccatcacgctgccctgctcaatgacgcgggcaccggaaatcaacgacaacaagctcgatttaccgacaccatccggtccaatcagcccgaccatgcaacgggccggaatatcgagtgtgatattgttcagcgcaacggtttttccataatgctggctcacgcccgccagttgcgcgacaggcgggacgggaaccagttccagatgcgtcattgcggcaacctcaccaccaggtcgtcaggccacggaagttcttcattcacccgcacccacgctacgcccggcaatccggttttgacatattccagatgctgctggagtaattccggtgggatacgcgctttgacgcggaacatcagtttcagccgctcatcgctggtttcgacggtttttggcgtgaactgggcgacgctggcgacaaaactgatggttgcaggaatacgcagatctggtgcagcatcaagaatcaaacgtgcttcaccgcccagtttcagcgtgcccgcctgttcggttggcagaaagaaggtcatatagacgtcgctgagatcgaccatattcagcacccgaccgcctgctgccagcacttcgcctggctcggcaacccgatactgcacgcgtccgtcacgcggggctttcagttcgctgtcatcgatatctgcggcaatgcgccgttcagtggcttgtgccgcttcgacgcgagtttgcgcctgaatgatattggtgcgtgccgcctctatagcggctttagaagcagaaacctgagcttttgccgattccagcgcagctcgggcgctctcagcggcggcgcggtcgtcatccaactgttgcgcagaaattgccccccgttgtgccagtgagcgggaacgcgtatgacgttttgctacggagtccagttctgcctggcgttgattaaccagcgactgtgcggcacgagtttcgctttggcgttgctccagcaaagcctgcgcggcggcaacggcactttgtgcttctttgatttgcgcgatggcttccagtcgctgttcctgcaacacgcgagtatccatcttcgccagcacttcaccttctcgaacaaactggccttctttcaccagaatggtgtcgatacgcccggcaattttgctggcgatatccacttccgtcgcttcaatgcgcccattgctgacagcaaagccttccggcacacccgccgggcgcaacagccaccacgccacgacggcagccaccgccagtgccccgacaccccaccacgccagatggcgcttactcttatccataatcgatccgccataatccctgtaagcaatcgacgcgtgttacaactgccaccgaacgatgttcagcggattcttccatccgggataagaaggaaatggcaaatacgaccagcgcacagagcattgagcgccaatggggaaggcttagtgaaaacgggtagtaatgttgtcatcatcagcattcctggccgtaaatgaaacacgcatactcataagtgaaatcaattaaatactaacagttatattcatgttgtctatttgattgccatcaacttgtgatacatcgcgatgttcttccgttcgctggtgttttttccaaaaatattctgtacaggttcacagattctgttgcacaggtttccgtaacagggaaacctgatgactatcacataacgttattatcgcctgatgtgcgaataaataccgaatataaaataatttattctgaaaagatgatagatgataaaggttcgtgggtttaataaaatattccctaaaagattcatttaaaacaacaaaataagataaagatattaattcagagtttatcttaggataaatatttatttaatagcattaactcaccgctaaaagttgatccccataacgctaaatccgattatagtgaagttactttttttaattgatggcatcttatagacatatttaactaactgaaaagacgaatcatatgtttttcgaagtgtagcagaaaatatatatggggtttaaaatgaatatatatatcggatggttgtttaaattaattcctttactgatgggtataatatgcatcgcattaggtgagtttgtattaaccggttctgggcaaagtgaatatttcgttgcagggcatgttctgatttctctttctgcgatatgtctagcattgttcactaccgcatttattattatatctcagttaactcacggcatgaataaattctacaacaggttatttcctgttattggttatgccggttctgctacaactatgatttggggatggtcactgttggcaagcaataatgtgatggcagatgaatttgtcgccggtcatgttattttcggcgttggcatgattgccgcttgtgtatcaaccgtagcggcatcttccggacattttctgttgatccccaaaaacgcctcgggcagtaagagtgacggtacgccattgcaggcctattcttcaacaatcggtaattgcttaattgccgttcccgttctgcttactctctttggtttcatttggtcagtcgtactgttacgtagtgcagatatcacaccacattatgttgcaggtcacgtactaatggggttaacggcaatttgcgcttgtcttattggccttgtcgccactattgtccatcaaacgcggaatacgttctcagtgaaagaacattggctgtggtgctattgggttattttgcttggctcacttaccattatttttggtatctacgtattaatcagttcagatgcaagcgcccgcctggcccccggcattattctcatttgcctggggatgatctgctacagtattttctccaaagtgtggttgttagcgctggtatggcgacgcacatgttcgttagccaacagaatacccatgattccggtatttacctgtctgttttgtctgttccttgctgcgttcctggctgaaattgcgcaaaccgatatggcttactttattccttcgcgagttctggttggcttaggtgcagtttgttttacactgttttccatcgtttctatattagaagcgggttcagcgaaaaaataataaaaaaggcttcagataaggcgttgagcgccttatctggttttattcaggttaatccctctggtatcgagagcgcattttgcttcttattctgccaccaaatcctgcgcacaagcccatgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcacttcggcagtgcgatagccttcagtgccgttgggttgtacgcgccagtcagtcaatgtgctaatcagtgtctgttggtcacgcacgttgagctgttttagcgagacatccgggatttgcccgagttgttgtaaccgttcaaccaaccgcttcggcagatgaaccgccagcgtgtttttcaggctttgattcggatgtgcattacgctgctcattcaggaaggtttcgaggtccacatccggtagcagattgatgctgacaaattcacccggttgccagtagctggaaatctgcaacaccgccggtccagataagccgcggtgggtgaagagtaagttctcacggaaaacgataccgttttcagcggtaatcacggaaggcaccgccacgcccgccagcacctgtaactcctcgagcaacggtttatgcagagtgaatggcaccagacccgcacgggtcggcagcacgttgaggccgaattgttcggcaatcttataaccaaacggcgatgcacccagccccggcattgacagtccaccggtcgcaatgaccagcttttcgcaaccgacagtcatgccgttcagttcaagcgtgaagcctgtatcatccttcgccacgctcagcacttcgctacgcaatctgaaggccacattgcccttctcgcactcatccaccagcatgtcgacaatctgctgcgcggagtcatcgcagaagagctgccctaacgttttctcgtgccaggcgatgccgtgtttattgaccagatcaatgaaatcccactgggtaaaacgcgcgagtgcagacttacaaaaatgcggattctggctcagataagcgcccggttcgacataaaggttggtaaagttgcagcgcccaccgccagacatgaggattttgcgccctggttttttaccattatcgatcagcagaacccggcgtcctgcctgacctgccaacgcagaacagaacatccctgccgcaccagcgcctataataatggcatcaaacctttccacgttgcgctcctctaagaaaaaacgggcgtgaattgtaaagattcctcagtggtcgcaccagcatcaatattactaaaaggaagtatttgcctgaattatataagataattattttttgagtgtaatccatacaggaggcaaatcaaaaaaagtctatatttcactttgcccgcgccgcgaaagtcactgataatgcgccgcgttcatgtcctcaaaatggcgtaacgtcctatgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtattcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctaggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttccctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcatggcgcgaacgatggtcagaaaggcattggtctggttatgttggtattgattggtgtcgcaccagcaggcttcgtggtgaacatgaatgccactggctacgaaatcacccgtacccgtgatgccatcaacaacgtcgaagcttactttgagcagcatcctgcgctgctgaaacaagcgaccggtgctgatcagttagtaccggctccggaagctggcgcaacgcaacccgcggagttccattgccatccgtcgaataccattaacgcgctcaaccgcctgaaaggcatgttgactaccgatgtggaaagctacgacaagctgtcgcttgatcaacgtagccagatgcgccgcattatgctgtgcgtttctgacactatcgacaaagtggtgaagatgcctggcgtgagtgctgacgatcagcgcctgttgaagaaactgaagtccgacatgcttagcaccatcgagtatgcgccggtgtggatcatcatggcggtcgcgctggcgttaggtatcggtacgatgattggctggcgtcgtgtggcaacgactatcggtgagaaaatcggtaagaaaggcatgacctacgctcaggggatgtctgcccagatgacggcggctgtgtctatcggcctggcaagttataccgggatgccggtttccactactcacgtactctcctcttctgtcgcggggacgatggtggtagatggcggcggcttacagcgtaaaaccgtaaccagtattctgatggcctgggtatttacccttccggctgcggtactgctttccggcgggctgtactggctctccttgcagttcctgtaatcgtacgcaccaaaacgagcgggtcagtttactggcccgctttttttatgcgtcattattgctgaagtgcttaatgccaaatcatcaatgcaatcaggctgaccaccaccagaccacacaatgcgctggtcagaataaactgccgacgcacccgctcacagcggcgaataaactcatcatcgtgatgatcgcgataacgttgggcatagatataccaaacgagacgcacctgtttgttgggttggccatgtgaggtaaaaaagccccctccatcaacatattgatagagcaatggatcgcagttacgcagtaccactaacaacgcgcgtagtgatgagaaatagcgcgccatgttaacaatgcaaacgacacataaagcccaaaataatgcgacggtgcttatcatacctcctccccggcgacctgcccgcggagttccaccccggggctaccgctcccgatacgctgccaatcagttaacaccaggtcctggagaaaccgcttttgtggtgaccaacatccgagcggctctatagatagtgtaggagatcaggttgttttttttccagaaggttaaccactatcaatatattcatgtcgaaaatttgtttatctaacgagtaagcaaggcggattgacggatcatccgggtcgctataaggtaaggatggtcttaacactgaatctttacggctgggttagccccgcgcacgtagttcgcaggacgcgggtgacgtaacggcacaagaaacgctagctggccagtcatcgacaactttatggaaggagtaacactatggcttataaacacattctcatcgcggtcgacctctccccggaaagcaaagttctggtagagaaagcagtctctatggctcgcccctacaatgcgaaagtttctctgatccacgtagatgtaaactactctgacctatacaccgggcttatcgatgtgaatctgggtgatatgcagaaacgcatctctgaagagacacatcatgcactgaccgagctttcaaccaatgcaggctacccaatcactgaaaccctgagcggcagcggcgatctgggccaggtactggtcgatgcaatcaagaaatacgatatggatctggtggtttgtggtcaccaccaggacttctggagcaaactgatgtcttccgcacgtcagctgatcaacaccgttcacgttgatatgctgattgttccgctgcgcgacgaagaagaataatcttccctccacgacgtgttcctgaacgcccgcatatgcgggcgttttgctttttggcgcgccttgttacctgatgcagcgtaaacgccttatctggcctgcggtctgcgtacgcaatcaaaacccctgccaatacaacatttaacaccatcatattttctatcattagtgtgatcagctggttattttctgttgtaatagtgtattaatctattctccgcatcaatattaagaatctctgacagatgtaaactttttcgcgcgttatcccttacgcgttaatacttttcaggatggtattggaaggttaataaatatgaatacaacaacacccatggggatgctgcagcaacctcgcccatttttcatgatcttttttgtcgagttatgggagcgattcggctactacggcgtgcagggcgtactggcggttttcttcgttaaacagcttgggttctcgcaagaacaggcttttgtcacttttggtgcttttgctgcgctggtctatggcctcatttccattggtggctatgttggcgaccacctgctgggaaccaaacgcaccattgttctcggagcacttgtgctggcgattggctacttcatgaccggcatgtcgctacttaagcctgacctgattttcatcgccctggggactatcgctgtcggtaacggcctgtttaaagctaacccagccagcttgctttcgaagtgctacccgccgaaagatccgcggcttgatggcgcattcaccctgttctatatgtcgatcaatatcggctcgttgatagcgttatcgctggcccctgtgatcgctgataaattcggctattcagtcacctacaacctgtgcggtgcagggttaattatcgcattactggtttacatcgcctgtcgtggaatggtgaaagacattggttctgaacccgacttccggccgatgagcttcagtaaactgttgtacgtattacttggcagcgtggtgatgatcttcgtctgcgcctggctgatgcacaacgtagaagtcgccaatctggttctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacgtcgctgaacttctttgccatcaacaacgtgcatcatgaaattctcggcttttccatcaacccggtcagcttccaggcgcttaacccgttctgggtggtactcgccagcccaatactggcaggcatttacacgcatctgggtaacaaaggcaaagatctctcgatgccgatgaagtttactctcggcatgtttatgtgctcactgggctttttgacggctgcagctgctggaatgtggtttgcggatgcccaggggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcagtaccagacaacattaccgatccacttgagacgttgcccgtctataccaacgtgtttggtaagattggcctggttacgctgggcgttgcagtagtgatgctattgatggtgccgtggctgaaacgcatgattgcgacgccggaaagccattaattattcttgcagaaagcggggtagcgttatcgctaccccgctttacttttacaccggcgttccggcgtaaatatcaaagcgatgccctttagtgactaccgcgtttggcgtggcgacattcgccagcggcggcgcatagtccggacgcttcaccaccacgcgtttggttgccagcaaccgcgcaggctccaacaatccatcggcatcaagatccggccccaccagcgactgaaacacgcgcatctcttttttcaccagcgcgcttttctgcttatgcgggaacattgggtcaagataaactacctgcggacgcggggtgatatcgctcagcgccgtcagactggaggcgtgaatcaactgcaaacgttcctgtaaccagccgccgatttccgcatccgcataaccacgcgccaggccatcgtcgagcagcgcggcaaccactggattacgctccagcatccgcacgcggcagccgaccgaagccagcacaaaggcatcgcgccctaatcctgcggtggcgtccaccacatccggcaaataatcgcctttaatgcccaccgctttcgccaccgcctctccgcgaccaccgccgaatttgcgtcggtgcgccatcgccccgccaacaaaatcaacaaagatgccgcccagcttcggctcatcacgcttgcgcagttccaggtgctccggcgttaacaccagcgccatcaggttgtcttcatcgtgctccagcccccagcgggccgccagaacagataaggcgccgtctccggcgcctgtttcatcaattaagcagattttcactgaatgttcagcccttaatgccgtaatgctccagcatcgcatccagctgtggttcacgaccacggaagcgtttgaacagctccatcggctcttctgaaccgccacggctcagaatgttgtcgaggaacgactgcccagtttcacggttgaaaatgccctcttcctcaaaacgcgagaaggcatctgccgccagcacatcggcccacaggtagctgtagtaacctgccgcataaccaccggcaaaaatgtggctgaaagcatgcgggaaacggccccatgacggagacggtaccacggcaaccagtttcttgatttctgccagagtttcgaggattttcgccccctgatccggacggaactcggcatggaggcggaaatcgaacaggccgaactccagctggcgcagaataaacagcgccgcctggtaatttttcgctgccagcattttatccagcagctccttcggcagcggctcgccggtttcatagtgaccggagataaacgccagcgcctccggctcccagcaccagttttccataaactggctcggcagttcgaccgcatcccacggcaccccactgatcccggaaacaccagcggtttcaatgcgggtcagcatatggtgcaggccgtgaccgaactcgtggaacagggtgatcacttcgtcatgggtaaacagcgccggtttaccatttaccgggcggttgaagttgcaggtcagatacgcgaccggtttttgcagcgaaccgtcggctttacgcatctggcctacgcagtcatccatccacgccccgccgcgtttgttttcacgggcatacaggtcgaggtagaagctgccgcgcagttcgtcgttctcgtcatacagctcgaagaaacgtacatccggatgccagacatcaacatctttacgctctttagcggtgatgccgtaaatacgtttcaccacttcaaacaggccgttaaccgctttgttttccgggaagtacggacgcagttgttcatcgctgatgctgtagaggtgctgtttctgtttttcgctgtagtaagcgatatcccacggttgtaactcatcgacgccaaattcggctttggcgaaggcgcgcagttgcgccagctctttttcgccttgcgggcgcgcgcgttttgccagatcggttaagaaatccagcacctgctgcgggttttctgccattttagtggcaagtgatttgaaggcgtagttttcaaagcccagcagttgcgccagttcgtgacgcagcgcgaggatctcttccatcaccttgctgttgtcccacttaccggcgttcggaccttgatcggaagcacgagtgctataagcgcgatacatctcttcgcgcagggcctggttgtcgcagtaggtcattaccggcaggtagcttgggatatccagcgtcagcaaataaccttccagctctttcgcttcagcctgggcttttgccgcagccagcgcgctttctggcatccccgccagctccgcttcgtcggtaacgagtttggtccagcccatcgtcgcatcgaggacgttgttgctgtactggttgcccagttcagaaagacgggtagcaatttcgccgtaacgctgctgtttctctttcggcagaccgatgccagagagttcgaagtcgcgcagtgcgttatcaaccgcttttttctgcgccgtgttcagcgtggcgtaatgatcgccatcgcgcaggtcgcgatatgccttatacagcccttcatgttgccctacccaggtgctgtattctgacagcagcggcagggtttgttcgtacgcttcacgcagttccgggctatttttcaccgagttcagatggctgaccggggagaagatacgccccagcacatcgtccacttccgccaacggctggcagagattttcccaggtgtacggtgccccttgcgctactacgcgctccacattttcgcggcagtcgttcagcgccttagtcacggctggaacgacatgttccgggagaattttagaaaacggaggcaattcaaagggagtcagtaacggattcgtcattagcgcagtcctggttaaagaggttaaggaagcgctcaacaggcgctttacataatgtttgtagcatggggttaagtgtagtgaatttcaatgagaaacgttacgctttcgcggcggcggcctcttttcggtatactgtcctgataggcttttgtgcgccccgaatacgggccgatttttacttaccggaacacctttacccatgctcagttatcgccacagctttcacgctggcaaccacgccgacgtccttaaacataccgttcagagcctgatcattgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcctgcggagctggaggcgtacatcaatgtggtaaaacacttcaaccgtagcgggcagttgcgttattaccccggttcgccgttgattgctcgccagctactgcgtgaacaggacagcctgcaactgaccgaactgcacccgagcgattacccgttgctgcgttctgaatttcagaaagacagccgtgcgcgcgtcgaaaaagccgacggtttccagcagcttaaggccaagctgccgccggtttcccgccgtggtttaatccttatcgacccgccgtatgaaatgaaaaccgactatcaggcggtggtcagcgggatagcagaaggttacaaacgtttcgccactggcacttacgcattgtggtatccagtggtgctgcgccagcaaattaagcgcatgatccacgacctggaagcgaccggcattcgcaaaattctgcaaattgaactggcggtgctgccagacagcgatcgccgtggcatgaccgcttccggcatgattgtgattaacccgccgtggaagctggaacagcagatgaataacgtgctgccgtggctgcacagcaaactggttccggcaggcaccgggcacgccaccgtaagctggatcgtgccagagtaattgcagccattgctggcacctattacgtctcgcgctacaatcgcggtaatcaacgataaggacaatatgtcatgactaaacactatgattacatcgccatcggcggcggcagcggcggtatcgcctccatcaaccgcgcggctatgtacggccagaaatgcgcactgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgagaacgtgctcggtaaaaataacgttgatgtaatcaaaggctttgcccgcttcgttgatgccaaaaccattgaagtcaacggcgaaaccatcacggccgatcatattctgatcgccaccggtggtcgtccgagccacccggatattccgggcgtggaatacggtattgattctgatggcttcttcgcccttccggctttgccagagcgcgtagcggttgttggcgcgggttacatcgccgttgaactggcgggcgtgattaacggcctcggtgcgaagacgcatctgtttgtgcgtaaacatgcgccgctgcgcagcttcgacccgatgctctctgaaacgctggttgaagtgatgaacgccgaaggcccgcagttgcacaccaacgccatcccgaaagcggtagtgaaaaatgccgatggtagcctgacgctggagctggaagatggtcgcagtgaaacggtggattgcctgatttgggcgattggtcgcgagcctgccaatgacaacatcaacctggaagccgctggcgttaaaaccaacgaaaaaggctatatcgtcgtcgataaatatcaaaacaccaacgttgaaggtatttacgcggtgggcgataacacgggtgcagtggaactgacaccggtggctgttgcagcaggtcgccgtctctctgaacgcctgtttaataacaagccggatgagcatctggattacagcaacattccgaccgtggtcttcagccatccgccgattggtactgttggtttaacggagccgcaggcgcgcgagcagtacggcgacgatcaggtgaaagtgtataaatcctctttcaccgcgatgtataccgccgtcaccactcaccgccagccgtgtcgcatgaaactggtatgcgttggaccggaagagaagattgtcggtattcacggcattggttttggtatggacgaaatgttgcagggcttcgcggtggcgctgaagatgggtgcaaccaaaaaagacttcgacaacacggttgccattcacccgacagcggcagaagagttcgtgacaatgcgttaaatgttaaagggctaagagtagtgtgctcttagcccttagctacgtttccgctatcagttcagaagctgaagcagaaagcggatcagttccagcagcgcaattaacgccccaagaacgatgattgctttatcaatcacccgttttctccatgcgatggagtgagaatgcatccgcttactcatccattgcctgtcacggcgcatgtctcattgttagatgacgactatctcactccggccagagcatcagttaacggcaccacccgtacttcagaccaggactttgaaagcgtttatgcgcattgccagagtgaaaatgtctcagagctaactggataatcatacagtacttgcgggttataaaaccagcatgtccttgcaatagtttcagtatggtattagcattgatgcgttagatgatggctatctcactccagccagagccaccaactcagggctgaacagtaaaaaaaccgacgcgaagtcggtttttttacgtcctgattcagacctcctttcaaatgaatgcccaacgcttaattcacacctacacctttctctacacttacatattcgttaaaccatatgtgtttttgacttgtccgctttggtttgtaactctggtggcgctggcgctacacctctctttcacatcgtaatgagatactgatatgagcaacattaccatttatcacaacccggcctgcggtacgtcacgtaatacgctggagatgatccgcaacagcggtacagaaccgaccattatctattatctggaaacaccaccgacgcgcgatgagctggtaaaactcattgccgatatggggattaccgtacgcgcgctgctacgtaaaaacgtcgagccgtatgaggaactgggccttgcagaagataaatttactcacgatcagttaatcgactttatgcttcagcacccgattctgattaatcgcccgattgtggtgacgccgctgggaactcgcctgtgccgcccttcagaagtcgtgctggaaattctgccagatgcgcaaaaaggcgcgttcaccaaggaagatggcgagaaagtggttgatgaggcgggtaatcgcctgaaataaagcggctatattcccccacaggttgttagaaaaatgcgctttatttatgtcggatgcgacgctggcgcgttttatccgacctacaaagttatgataattcgatgaattgtatgttatttgtaggcctgacagtcgtagcgtatcaggcgattttgctatttacacagtactccctgcgtgagattccaattatcgcgtccagcatggtgtatcagtgagctgcttagttatcagcgatacagtgcagcagtttaaagatgtactggattatgatttatcagtggtttacacaataaataatttcaacatacgttaacctattttattattacatatctaaaacatcacaaaaatatcacttcacacactatcagagaacatcatacctttttaaaacgagcattttcgatagttgttaacgttttcttttgcgatatgattattgcctttttttgcactcaaatattaccagatggaaataaaagagaagtcaaaggtaattatatcaggaagatatgacgcattatatttactgtatgtagaagaaaatccattcctgttctaattatccaatttaaaaatcttagcataaaacaaatgatgaataaggaatgttatgtcaattgactttaccccaggtgtaataaatacatataacggtgatatttataactgcacaacaaataccgataatgttaaaacgccagacacaccgaagtggccttgtgataaccgggaagaacaacaccccattaatgccccattctctggagaatggatacacctctgaacaatttgatttagcgcaacaacgccaacaaattaatgcgtgccatacgaacaccacatatacaaatgcagactactcaaagttgaggctcaacttgtaagtcttattaataacattgaaacgataagctcgacaccacttccgcaaaagacacaatcaatacttaatcagataaataatattagacacgaaaagattaaaaacctctgaatatagattatggaacaatggatactcatgccacgcccaaaaattaactgagctcaactaaacagaagagatataaacatcagacaggtttacgttactatcaggcatatcgcctcagaatcagatgaaaactataaagaaatatctattatggttttaatatttgttgataaggatagtaacatgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggcgggaaggttatcaacgttatcaatggcaaaacggatacgttgttagaaatcgctgtattaccgttggatagctatgcgaagcctgatattgaagccaactatcagggccgactgctcgccagacaaagcggcttccttgatccagtgaactatcgtaatcactttgttaccatcctcggtaccattcagggtgaacaacctggctttatcaataaagtcccgtataacttcctggaagtgaatatgcagggcatccaggtgtggcatttgagagaagtggttaataccacctataacttgtgggattacggctatggtgcattctggccggaaccgggctggggggctccttactacaccaatgcggtgagtcaggtaacacctgagctggtcaaataacaccaccgaaagatgcagatgctttctcagtatctgcatcatgcattacatcaaattaatacacagtaagctaactattattataagccctgtcctgttaattacctttggcaaacttattataaagttaatgtccgtaccaggagtcggttatgtttcttataattaccagggatacgatgtttttcaccgcgatgaaaaacattctgagtaaaggtaatgtcgttcatatacagaacgaagaagagatcgacgtaatgttgcatcagaatgccttcgtcattattgatacattaatgaataatgtatttcattctaattttctcactcaaattgaacgattaaaacctgtccatgtaattattttctccccctttaatattaaacgctgcctggggaaagtaccggtgacctttgttccgcgaactatcgccatcatcgactttgtcgcactcatcaatggcagttactgctctgtgcctgaagcggatgtgtccctctcgcgcaagcagcatcaggttctgagctgcattgcgaatcaaatgacaacggaagatattctggagaaactgaaaatatcgctaaaaacgttctactgccataaacacaatatcatgatgatcctcaatcttaagcggatcaatgagctggtacgccatcagcatattaattatctggtgtgaacgattgaacaatataaagaggcccagcaacagccagacctcccgttaattatacgttatgcagtaacgccttccggtatcaacgaagcaatttgcttacgccattgcgcttgctcctgttcaccttctgtacgttgaccataaagttgcgctatctgcgtaccatcatgggcaaacaattccagactggttacgtgaccatcgctggtcggtttacgggtaacccaggcttcagcaatgctctcttctaatagatgaagggtaaacgtcgggttgaaaatattcagccaacctttcattggcaccactttttctaccacaccggtgaaaatctgtacgcagccacggttgccaacaaacaccatgatttcattgccatcctgctgtgcagattcaagaatttgcgccaacgcactgttggatactttgcaggccaaatcgtctgccaccagattgaacgcctgttggcgcgtcaggttgtggcgcttgagcaacgtaaaaaactgatgaacgtcggtcatcgcccgccactcttgctcgaccacactggcatcggctcgcgtttgaacaactggcgcatcaacggcttttaactcaagcggcgtattctcatcggtgataaaccgtgccagaagctcactccatgccgccatatcggtattgtcggtggcataaacttttagtaatgcatcgccctgatgatcaaagaactgaatactctggcgttcgccacgagccgtgttttctttgatgtggaaaacactggcccattgattgagaaacagacgtaaatccagcgcgcgcggattgaggatcaatccggcatgtccgttcaaatgctggtttgtgaacgagccaacttgctcatggactgcatattcattacgacaaatacatttggtttcaccaacgctttccagcgccgccagaatttcacgaatatcgccgcgcatccgccacgcgtcgtgcgtgacgcgtgcaaatgccagttctgcttcgctgatattcattaaacctgcgatgtcacgcgcgtactttccgggattttgttcttttaactcaagccagcgtgtgtagtggttcattgtctctcttccttccagataaatgccccgaaatatcggggcagatgattaccattgataactcacgaaaatttttccgttacgaccatcctgtgggatgccttgcggcgaccagtactctttatcgaaggcgttgcccaataccagagtagtggtcacgcctttgagcgcctgttgtccttgataactgacgtagaaatcattcacaccatagccaggttgtttgctgtagctgctgctgatatgtgttgagcgatcggcaaacgtaccgacccaaccaacagagaagccactgtgagcgatcggaatattcagggtactggtaacggtatccgggttaatgctggagatatattccccggtatcggtgtctttgccgcgggtacggttataggccacatcaaggctaaacagatcagtggtatatttcgtcatcacatcccagccccagattttggcgttcgggacgttatacgacatagttgtcgccgccgcgaaatcgacggtcgtggagatataatctttcgctttggtatcaaagtagctggctttaaattccagagcatcattggacaacatcaggtcatcaaaacgcagcccaaaaccgtactcctgagtttcgttagtttccggacgtaagttcgggtttggcacccaatagttggtatagaagcgaccaatcgagaagtgtttagaatcgttatacatttcgcccatcgtcggggcgcggaatgcctgagcatatgagccaaataacatcagccagttggtcgggttgatagtcatccccgcacgagatgaccatttgtcggcatcaacatctttgtagccgtcgctgctaccgcgataactgtcatagcgggttccgccaagcagggtaatcggcagatcgcgtaaggtgatctcatcttgtagccagccagagctaaaatcgatttttgcttgcgggaagcccgtcgtcgcgccacccggatgttgttcctgacgataatactcaccgccatatgtcagtaagtgagaagcgaaactgtcggcaaatagagtggaacggttctccagcctggctccttttgttatctgttcacgatactcgccggaactccccgtgttttgcgcattaatacggacttccgaccagtatatttttgcatctgcatttaaccagtcgttaccctgcggggcgagtttataagaaagctgcgcatcgcgttgaattgttgaacgatcgaccatcgggttgctgctatcagaagcttcaacggtctgcggattttttggttcacgcgcgtcgttgttgtagtaacgcactaaaccgctcagagactgggctgaatcaatttgccaggtccctttcgccagcatgttattaatggattcgtcattcggcgcggtttcaccattgctctggcgtaaatcaccccgatcgcgactggaccaagccacaataccatccagattttcagttcgcccaaacgcgctcgcgcctaatcccaggctatggtcccccgtgccgccagtaccaaagacacgaaaaccactactttgtccttcctgcaataaatcttttgcatcgaccgtatcgtaggagatcactccacccagcgcgccactgccatacagtaatgctgaaggtccgcgaacaatctcaacacgcttgatcagcgccggatcgagaaaagtgccattcaggtgtccggtatccgttccctggcgaacaccatcgacaagaaccagcacgccgcgatgatcatagccacgcatatttacatcctgaccgttggttcgtccggtaccatcaagagtaattccaggaacatgacgcagcaaatcagtggctgaagtagcagtttgattttcaggagcggaagtgtcgataacgctgaccatcataggcgcttcgaaggaactacgtgcattccccgttgccgtaacggtcatggtttcagtagcaaaagcaaacgttggcaaggtggcagaaacagccaaagccaacaaactcaaacgcaacgaggtaaattgcggacgtgacatagcgattctccatgaggaaaataaaaaatgctggctgcctgggttaataccggggtggctggcgaaaaataaatttatttacaattcaaataattagatatcaccacgggaagctattagcgtatatatcccgtaaaattgccgaatatttctgataattcagcaaaagcacgccctctttgtcaggcaaagtagtacgccacgtctgaagtgaagagtgctgtgcgttttcccttacaaaagatatgattttgttatccatgatgtcatattttgttaaactcaaacgtgataatgagaattattatcgatcaattttttatgatcaagctttttttaaccgccattaacacaataaacagggggttatgaaatctatccagcatccagaaaaccatcctgtgtttatggctatccccccacaacctcatcacaaaacgttgtcgttaacagtgataattttctcttctctttgctctgcaagccgcgatatctccgggttctcagctttttcccgcgctgaaatttaatcggtaacaagaacattagctgacgaagcatcttgataaaaatcaaaaataaatacgcttgtaacgccgtgcgtattgaatcgacggttgtatttcatatataactcaaatgataatcatgatcattctcaatttgataagagttctcacattatgccaaggatcatcaccaggccgtttcttttttccccactaacgttatgtatttcagccgtggcctctgccgcgaagaccatggtaaaacgaaaaaaattgtttacggcattactggctcttagctggacttttagcgtaacggctgccgaacgtatcgtggtcgcaggaggatcgctgacggagctaatctacgcgatgggcgctggcaaacgcgtggttggtgtcgatgaaacgacatcttatccaccagaaaccgccaaactgccgcatattggttactggaaacaactcagcagcgaaggcattttgtcacttcgcccggatagcgtaattacctggcaggatgcaggaccgcaaattgtgctcgaccaactgcgggcgcaaaaagtcaacgtcgtcactctgccgcgtgtaccagccacccttgagcagatgtacgccaacattcgccaactggcaaaaacgttacaggttcctgaacaaggcgaggcgctggtgacacagatcaaccaacgcctggagcgagtacagcaaaacgtggcggccaaaaaagccccggttaaagccatgtttattctctccgcaggcggaagtgcgccacaggttgccggtaaaggcagcgtcgcggacgccattctttcgcttgccggagcagaaaacgtcgctacccaccagcagtacaaaagctacagcgcggaatcgctgattgcggctaaccctgaagtgattgtcgtcacctcacaaatggtcgatggcgatattaatcggctacgttctattgccggaattacccacactgccgcatggaaaaaccagcgcattatcaccgttgatcaaaacctgattctgggaatgggtccgcgtattgctgatgtcgttgagtctttacaccagcagctttggccgcaataaatggatttaaatcagacgaatgaacacaaataacaccctggatctcacgccacattttgctttagacggtgatcagccctttaaagacaggcgcgccatgatgccgtttcgtggggccattccggttgccaaagagcaactggcacagacctggcaagagatgatcaatcaaacggtatcaccacgtaagcgactggtttacctacacattcctttttgtgcgacacactgcacgttttgtggtttttatcagaaccgttttaatgaagatgcgtgtgctcattataccgatgccctgattcgtgaaatagaaatggaagcagacagcgtattgcatcagtcggcccccatccacgcggtctatttcggtggcggtacgccttccgcgctttcagcacacgatttggccagaatcatcaccacattacgagaaaagctgccactggcccctgattgtgaaatcactatcgaaggccgggtactgaattttgacgctgagcgaatcgatgcttgccttgatgcaggagcaaaccgcttctcaattggtattcagtcgtttaacagcaaaatccgcaagaaaatggcccgcacctcggatggcccaaccgctattgcgtttatggaaagcctggtcaaacgcgatcgtgccgcggtggtctgtgacctgctgtttggtctgccgggtcaggatgcgcaaacctggggagaagatctggctattgcccgcgatatcggtctcgacggcgtcgatctctatgcgctcaatgtcctgcccaatacaccgctgggcaaagccgtggaaaatgggcgtactaccgtgccctctccggcagaacgtcgcgatctttacctgcaaggatgtgattttatggacgatgccggttggcgctgcatcagtaacagccactggggccgtaccacacgcgaacgcaatctctataacctgctgattaaacaaggtgccgattgtctggcctttggttccggagccggcggttcgattaatgggtactcctggatgaacgaacgcaatcttcagacctggcatgaatccgtcgcggcaggcaaaaaaccgctgatgatgatcatgcgtaacgccgaacgtaatgcgcaatggcgtcataccttgcagtcgggcattgaaacggcgcgtgtaccgctggacgaacttacgccacatgccgaaaaactcgcgccgttactggcccagtggcaccaaaaaggcttaagccgcgatgcgtcaacgtgtctgcggttgaccaatgaaggtcgtttctgggcaagcaacattttgcagtctcttaatgaactgattcaggtacttaatgcgccagcaattgcgcttgaaaaaccataacaggagtgatttatgagccatgtctcgttacaggaatttttgaaaacggagccagacggtacgctggaggcgatcgccgaacaatacaacaccacgctgctggaggtagtgaaaaatctgccctctccgactgttgtgtcaggtgataaattcgatactgtctgggataccgtctgcgaatggggcaacgtcaccacgttagtacatactaccgatgtaatactcgaatttagcggcgaactgccttcgggtttccatcgccacggctatttcaacctacgcggaaagcacggcatgtccgggcatatcaaagcagaaaactgcacgcatattgccttgatcgaacgtaaatttatgggcatggataccgcctctattctctttttcaataaggaaggcagcgcaatgctgaaaatcttcctcggtagggatgatcatcgtcagctcctgagcgaacaagtcagcgccttccatgctctggcagcatcgttaaaggaacacgcctgatgacaccgtggctactctttggcgcaggcggaaaaggtgtgggtgccagaacgcttgaactggcgctggcggaacaacgtccggtcgttgctgtcattcgtcatgccgatgccgccacgaaactggcgcaacaaggcgtacaggtttttacaggcgacgcctgtgatgccagcgtagtcgcggctgcttgccgcgcaactggcccggatgcgcttatcatctcaacaatgggcggagctcaggattatctggcgcacagaacagtgattgatgaggccgagaaggctggcatcagtcgcatgattctggtgacctctttgggatgcggcgatagctggccgtttttatcagagcgggcaaaggctgcgtttggtcaggcggtacgggaaaaaacgctggcggaaagctggttgcaaaccagccagcttgattatgccattctccgccctggcggtctgcttgatggtgcggcaacgggcaaagcacaacggatacaaaatcaggagtgtcatggttttgttaaccgtgctgatgtcgccgcacatatccatgaactggcaaatgcgccagcacttaaccagcaggtctacagtctgattgaaccggacctgaaaccggcgtgatcccccggcgcggcatgtccgcgccgtaatgtcgtaacggagttttgcgtgctcaaggattcactctcttccgccagggtctttatggggctatcactattattgctagctctggtgctgtttggtgccagtcagggagcgttaaagatcagttttgatgccctttttgatgaggaataccgcgatatctggctcaatattcgtctaccacgggttttgctggcggtgctggtaggtgcagcgttggcaaccgcaggggtaattatgcaggggctttttcgcaacccaatggctgaccctggattacttggcgtcagtagcggttctgcattaatggttggcgttgctattgtgctgcccttctccttcccagtggtgctggtgctctatgagcaaatggtgtttgccattgccggaagtttagtggtctgcaccatcatttttctcatcacgcagcgccatcgcgatggcagcatgatgcaattattactcgccggtatcgccatcaatgccctgtgcggcgcagcgatcggcatcctgagctatatcggcgatgagcagcagctacgacaactcacattgtggatgatgggcaatcttggacaggcgcaatggccgacgttattggttgccagttcattcatcctaccggccattatcgcaacaacttgtctcgccggaacgctgaatttactgcagctcggtgatgaagaagcccactacctcggcgtgaacgtgaagcgtaaacgccagcaattactgttagtgagctcactgctcgttggtgctgccgtatcggtaagcggcattatcggctttattggcctggtgatcccgcatctgattcgcatgactaccggggcaaatcaccgctggctaatcccttgttccgccctcgccggagcctgtttattgctgatggcagacacgcttgcccgcacgctggtacagccagcagaaatgcccgtgggattattaaccagcctgcttggtggcccttattttatgtggttgattctgcgcaaccggaggatcacatgatcagcgcccagaatctggtttatagccttcaggggcggcgtctgactgataatgtctcgctgacttttcccggtggggaaattgttgccatcctcgggcctaatggtgcgggaaaatctacgctgcttcgccagctaaccggctatcttcaacctgatagcggcgaatgtcggttgtttaataagccattaaatgaatggtcgattactgaactggcgaaacaccgggccgtgatgcgtcaaaatagccacatggcgtttccattcagcgtacaagaagttatccagatggggcggcatccgcatcgtactggtaatcaggataatgaaacagcacaaataatggcgttatgtgactgtcaggcgttagcaaaccgcaactatcggcaattatccggtggtgaacaacagcgcgtgcaattagcgcgcctgctggtgcaactctgggaacctactccctcaccgaaatggttatttcttgatgaaccaacttcggcgctggatattcaccatcagcagcacttgtttcgtttattacgccagttagttcacgaacggcagttcaatgtttgctgcgtattgcacgatctaaatcttgccgcgcgttatgcagaccgtgttgtattaatgcaaaaaggaaaggttatcgcaaatggtaagccgcaggacgtattgacacagcaggcgctgacaatgctctacggcgcggatattaccgtacttaaagatcctgccaaccattcaccactgatcgtcctcgatcattaaaaccaacaggagtaccgcactggtactcctgcgaataaataactatacagattagctaattgaaacgcctttcacccctgccataccttttaataatcgcaacagatcttctatcgacgtcgtggcatgaagctggatatcaatggcgaccacttcatgatcttcattttcctgcaacgaaactaaatccgtttttattttttgctgcttaaaccagtcgagcattgataccgtattaccgttcactaatgtcagctgtaaatggtaatttttgttcatcaggcggaaggttaattgatggaagacttccagcaccagcaaggtcatcactgaaccataaatacccagttcgtacataccgctgccaataaccataccaatggcggcggtcacccagatatccgctgccgtcgtcagacctacaatattttggttacgaacgagaatgttacctgcaccgataaacccgacgcccgtcacaacctgagcagcaatacggctgggatccagtccgacgtgacctaaagacagcacgtcagcaaaaccatatttcgaaacaatcataaacagggcgcttcccatgccaattaatacatgtgtgcgtaaccctgctcctttgccgcgcatttgcctttccatgccaatagcgccacaggcaattaccgcaagtataagtcgtataataaattctgctgtcatataaaaatgcaaaaaggagcagcaagatggctcaacttgctactcctttttacttgtaccttattaattcggcaagtcattagatgcttgatttttgaaggtatacaaatttttctgcgggtttttcttgcagtattcgatcactttaggaatttgagtgagatcggtttcatttaaagtaacggtatcgccacctttatatactgtttcttcatgcagcatccaccacgcaactggtgtcattgcttttggattcagatcaataaattcctggcaggtcatatctttagcggattcattggctgccagcgcagattgtgcgttcaccagtgacaaagccgctacagcgcccataaaaataaacgctttacggagagatgaaatgttcattttgtaacccattcaatatagagattatatacaaacaggaggaatagctgcttttaaagaagatattccggcctgttcaatatgcaaggaaatacgatgtaacgcattcccggaattacatatctttcttaattttgtcccattcgcctttaactttatctttaaagctggcttttttatcctgagtacaagcctgaacgatagctggggttacggttgcaataccctgaacatctaaaaccgcatcttctggtttatctttgttgttcagtgcttcagcaaaaccgactgcagttggctggaaggattcgtccacagccaggaaatcttcacaggtccaggagttgaccggttttttgttatcagctgctttttgtgcatccgctgcattgctcactactggcagaagaagcagaccaccaagaataacgcctaatacttttttcatcgtaatatcctcaactataaagtgaaagagccgtcacgaatcaatttcgacactgaggttataacctggttttctgtatatgtcatgttgatggaaaatatcaaaatcagatatttttatttcaatacaatgagttacagatgcatcagatactgtaattaggaaatttttattaaatcgactgcattcttagacgcgtttttggcatagattgatagcaggggattttcttcttaattttatagggtggttctatgttatatatagataaggcaacaattttgaagtttgatctggagatgcttaaaaaacatcgcagagcaatccagtttattgccgtgctgctgtttatcgtcgggttgctgtgtatcagttttccgttcgtctctggcgacattttaagcacagtagtgggtgcattattaatctgctcgggcattgcgcttattgtcgggctattcagcaaccgcagtcataatttctggccggtattatccggtttcctcgtcgcagtcgcctatttattgatcggctatttcttcatccgcgcaccagagctgggcatttttgccattgcggcatttattgccggtttgttctgtgtggcaggggttattcgcctgatgagttggtatcgtcagcgttcaatgaaaggcagttggctacagctcgttattggtgtgctggatatcgtcattgcctggatattccttggtgctacgccgatggtgtcggtaacgctggtttccacactggtgggaattgaactgatatttagcgccgccagtctgttcagcttcgccagtttgttcgttaaaaagcaataattatccctatttccacctggatcatagtcacattaagtgactatgatccagttaatactctcttagctatacagtgtttcagttcaattacgcactatcattgaaacaattgcctgctgttgattatttcaacctactgaatttaatctgatttttttcgttccatggcaaattagccatttcaaacattatcatggctgatattttccgtggtcaggtttaatgttttaaaagtgctgtgggaaagtgaacaaagagttccgtaagcgttgatgctatgggcggttaaataagtaatccgggttcatttttttgcaactggcgttgattacattgcataaatatccgtgtctccagacgctatataaaaacctgaagacatgaatgagttatttaatcaggtaatttcaatgcgttaaaagaaagctggcaatccaattgccagcctaagtcgaaacaaggagactcgatatttaaatcggattacattttaactttagtaatattcttcagagatcacaaactggttattgataacttattcttgggcagtaatccgcaaaagttaaccttttgtttactagttacaaactgataacaaccaggaatcttacttaggaccaatatatggagtgtgtgatggataaatctgaagtattgattagtgttaatagacgtattagttcacgaagggcaaagttcttataggcgtttactatattgaacaacgattcggacaaggatgtaaataatgaaaaggatgacatgttcgaaacgataacggctaaggagcaagttatgatttttctcatgacgaaagattcttttcttttacagggcttttggcagttgaaagataatcacgaaatgataaaaatcaattccctgtcagagatcaaaaaagtaggcaataaacccttcaaggtgatcattgacacctatcacaaccatatccttgatgaagaagcgattaaattcctggagaaattagatgccgagagaattattgttttggcaccttatcacatcagtaaactaaaagctaaagcgcctatttattttgtcagccgtaaagaaagtatcaaaaatcttcttgagattacttatggtaaacacttgccccataagaattcacaactatgtttttcacataatcagttcaaaattatgcaactgattctgaaaaacaaaaatgaaagcaatatcacgtcaacgctcaacatttcgcaacaaacattaaagattcagaaattcaacattatgtacaagctgaaattaagacgtatgagcgacatcgtcaccctgggtatcacatcttatttttagtaaggacataagcaactgaaattgatggctggcatgacgagggatgcagatgctgatttcaatacccccggtgattattgaaggagagacgaaaacgactttattcccctggtatgtgtatccaccagtagaacccttcgttgcccgcatgctggcagaaactgttggcagaacggcaacattttttttgtcgttgacctcaccatgtcgatcactgtgcttgcatcccatcttactggctgacaaccccactatgccgctggtctgtaaatccctcatatctctcctcgcgcgcaatttaaagaaccgttatttctcaagaattttcagggactaaaatgaacagaagaagaaaactgttaataccgttgttattctgcggcgcgatgctcaccgcctgcgatgacaaatcggcggaaaacgccgccgccatgacgcctgaggtcggtgtcgtcacactctcccccggttcggtcaatgtgttgagcgaattgcccggtagaaccgttccttatgaagttgccgagatacgtccccaggtgggcggtattatcattaaacgcaactttatcgaaggcgataaagtgaaccagggcgattcgctgtatcagattgatcctgcgcctttacaggcagagctgaactccgccaaaggctcgctggcgaaagcgctctctaccgccagcaatgcccgcatcacctttaaccgccaggcatcgttgctgaagaccaactatgttagccgtcaggattatgacaccgcgcgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaggatttcttgcgcatgaaagaagaggtcgccagtgggcaaatcaaacaggttcagggcagtacgccagtacagctcaatctggaaaatggtaaacgttacggccagaccggcacgctgaaattctccgacccgacggtggatgaaaccacgggctccgtgacgttacgggcgattttccccaacccaaatggtgacttgctgcctggcatgtatgtcacggcattagtggatgaaggtagccgccagaatgtattactggtgccgcaggaaggcgtcacccacaacgcccagggtaaagcaacggcactcattctggataaagacgatgtcgtgcagctacgcgaaatcgaagccagcaaagccatcggcgaccagtgggttgtcacctctggcttgcaggctggcgatcgggtgatcgtttccggtttgcaacgcattcgtccgggtatcaaagcacgtgcaatttcctccagccaggaaaacgccagcaccgaatcgaaacaataacgttgcaggcttaaggggactttcatggctaactattttattgatcgcccggtttttgcctgggtacttgccattattatgatgcttgcaggcggtctggcgatcatgaacttaccggttgcgcagtatccgcagattgcgccaccgaccattaccatcagcgctacctatccgggtgccgatgcgcaaacggtagaagactcggtcactcaggtgattgagcaaaatatgaatgggcttgatggcctgatgtacatgtcttcaaccagcgatgcggcaggtaatgcctccatcactctgaccttcgagacggggacatcacctgatatcgcacaggttcaggtgcaaaataaactgcaactcgctatgccttcattacctgaagcggtgcagcagcagggaattagcgtcgataagtcgagcagtaatatcctgatggtagcggcatttatttctgataacggcagcctcaaccagtacgatatcgcggactatgtagcgtctaatatcaaagacccgctaagccgtaccgcgggcgttggtagcgtacagctctttggttccgagtacgccatgcgtatctggctggacccgcaaaaactcaataaatataacctggtaccttccgatgttatttcccagattaaggtgcaaaacaaccagatttccggtggtcaactgggtggcatgccacaggcggcagaccagcaactgaacgcctcgatcattgtgcagacgcgtctgcaaacgccggaagaatttggcaaaatcctgttgaaagttcagcaagatggttcgcaagtgctgctgcgtgatgtcgcccgcgtcgaacttggggcggaagattattccaccgtggcgcgctataacggcaaacctgctgccgggatcgccatcaaactggctaccggagcaaacgccctggatacctcgcgagcggtgaaagaggagctgaaccgtttatcggcttatttccctgcaagcctgaagacggtttatccttacgacaccacaccgtttatcaaaatttctattcaggaagttttcaaaacgctggttgaggctatcatcctcgtcttcctggtcatgtatctgtttttgcagaatttccgcgccacaatcatcccgacgattgccgtaccggtggttattctcgggacgtttgcgatcttgtcggcggtcggtttcaccatcaacacgttaactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcgggattgccgttgttctttccgcagtgtttatgccgatggcctttatgagcggtgcgaccggggagatctaccgccagttctccatcacgctgatctcctccatgctgctttcagtatttgtagcaatgagcctgacccctgccctgtgcgccaccattctgaaagccgcgccggagggcggtcacaaacctaacgccctgttcgcacgcttcaacacgctgtttgaaaaatcaactcagcactataccgacagcacccgctcgctgttgcgttgtaccggtcgctacatggtggtctacctgctgatttgcgccgggatggcggtgctgttcctgcgtacgccgacctctttcttaccagaagaggatcagggggtatttatgaccaccgcgcagttaccttccggtgcaaccatggttaacaccacgaaagtgctacaacaggtgacggattattatctgacaaaagagaaaaataatgttcagtcggtgtttaccgttggtggctttggcttcagtggtcaggggcaaaacaacggtctggcgtttatcagcctcaagccgtggtctgaacgtgtcggcgaggaaaactcggttaccgcgattattcagcgggcaatgattgcgctaagcagtatcaataaagccgtcgtcttcccgttcaacttacccgcggtggctgaactgggtaccgcgtcaggttttgatatggaactgctggacaacggcaatctggggcacgaaaagctgacccaggcgcgaaacgagctgttatcactggcagcgcaatcaccgaatcaggtcatcggggtacgcccgaacggcctggaagatacgccgatgttcaaagtgaacgtcaacgccgcgaaagccgaggctatgggtgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctattcgtctaccgaatggacctatggttcaccgcgactggaacgctacaacggcatcccgtcaatggagattttaggtgaagcggctgccgggaaaagtaccggtgacgccatgaaatttatggcagacctggtcgcaaaacttccggcaggcgtcggctactcatggaccggactgtcgtatcaggaagcgttatcctcaaaccaggctcccgcgctatatgccatttcactggtcgtggtgttcctcgccctcgccgcactttatgaaagctggtcaattccgttctcggtgatgttggttgttccgttaggcgtcgttggcgcattactggccaccgatctgcgcggcttaagtaatgacgtttacttccaggttggtttgctgaccaccatcgggctttccgccaagaacgccatcctgattgtcgaatttgccgttgagatgatgcagaaagaagggaaaacgccggtagaggcaatcatcgaagcagcgcgtatgcgtttacgcccaatcctgatgacttctctggcctttattctcggcgtgctgccgctggttatcagtcatggtgccggctctggcgcgcaaaacgcggtaggtaccggcgtaatgggcgggatgtttgccgcaacagtgctggcaatttacttcgttccggtctttttcgttgtagtggaacatctctttgcccgctttaaaaaagcgtaacgtgtaaatgagagtaaggttgaacgtgagggttcagccttactctttcctgctaaccattcaccactcaacaaccagctaaccgtcaggaataccaggcttagtacacagcactgaaagtagaaaccactccagccattcgtcatcaatttgaacagcacaatactgacccacattcccgtaatcgtatgaattgttagcttaataatcccaaacatgccgagtcttttcctcctgaaaatacctataccgcctggcaaactacgaaagagaactagccggtagcccggcagaaatcatcaggaaagagtttcacatgaagcagacgtgagatcctgaccaatattcaaatgcgaaatatgtcaggaaaaggtacccggcgaatgttgcgaaaactgatgtggcgttacaccataatattgtctaaatgtatttataaagtatgacgtactgctatagccacatttttccgcaatagtatgcagaggtatttgacgtaactcgagtaatcgtctggccatcgacatcctggaggcgagtaatattttactgaaacaggtattttcatcctgcaacttttttttgatgagactctcgctggtgtacattctttctgcgatatcgcgtagataccaacgtttagcgatatcaaagctaataaggcgttcaacttttcctgaaacagtactgatactattgaaaagtaaggggatcagttctttcttatgagaaaacattgataaacaggaaagatagagcattttgctcagtatcggcgaattgacccgggggtcattgaaactatcaaaaatcgccgtcaccagctgtatggggggtgactggttaattaacaaacggtctttgctatgcaatcctaaattgcgtggcaactgacgaatattttgtaagtaatggcaaactgtcagctcttcgatatccagccgtcgcgtatcaagtgaacaaaacgcaaaatcgtctgccaaatttttatccagcagcaggatactctcgttatgcaacgatattttttgctgttcatgatgaatatcgaatgaacgacgaacgaggatcaccgagcagacatgagccatgactatcccttatatttcattactgcgattatttcaatgtcagtatactaatgaaatgacgccagactgtttctgtgtgcaaaaactgccatatttggtaggaccaaattttatccacaaagtagttttgcataacagttaattgataataagtaaatgcaacacgattatattttcacacagcgtatagcttatgtttataaaaaaatggctgatcttatttccagtaaaagttatatttaacttactgagagcacaaagtttcccgtgccaacagggagtgttataacggtttattagtctggagacggcagactatcctcttcccggtcccctatgccgggttttttttatgtctgagtaaaactctataatcttattccttccgcagaacggtcagtgccgtaaaaaatcccttgcgcagccatacttgccgccgagccacagttcggtaattcctgcgccgatcgctcctgatactctgtgggcgtcatcccataataatttcgaaaaacgtaaatgaaatacgacacgctgtgatatccacaggatactgcaactcgcttaattgaaaccccatatataacaataagttgtaaagcacgctgcatcctacactcagtaagcaactgtgaatatgacgtaccttcttcgcgcaattttttctttaacaggcttggactcatcaacaattcgctagcaattcgggctaatgtccactcatgggcgatattattattgatgaccgtacaaactcgtgttcgcatattcggttgcaacacgttcagaagtaacggtataaactgcgtatcctcaagaaaaacagataacaacgcaaagattaatgcccttttacgtagcatttctgcatagcgaagattcttattctgcgatagttgcgcaacttcctgaaaaacaggaatatctctggtacagtgatgaacgagtaatgaaggaacttttttatgtacatgaagttttaatgcctcctccttgagcatcgggagaaataatgaaagcgtgtctcttgaaactaatacgaaattctcaacacacttatccacttgaatttggcttgcatccgcaaaaaccagatcaccgccattaaaatagcgatattcaccattaaccatggtgagaatatatttatgtcttgcgtacgcaattagacaattaccatgtagtggttgcatagttgacttaatattacataaacatattactgtttattaatgtagcacgccgccctcttaagtcaaattgattgataaataaatttaaacgaagcgggaaaacaggatgataatgagcgatgatactcgggctggatgactggatttattatataaaaaggggacttaagaacgcagaggaattaatagtaagcaaataattcatcatcgtaatattaagcagtatcgctatgctccataacattcatataacatatatcttatcaacacgatgaatagacaggtaatatattattgcaattaataagtagccgaatacccacctgtttttaaaggttgggcattcggtttttacaacgtgatgttatcaggtgtgtttaaagctgttctgctgggcaataccctgcagtttcgggtggtcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcatacagagtgtatcccggatcttcaccatctttcagtttgaagcaaaccgccgggatgccttcgtccgggcgacccgtacagatgaactcatacggccccagtttggcgatttcatccgccagataagcagcaacctggtaggaagcgttctgtactttggtatagccttcacgaccgaggcgcaggaattcatagtactgtgcaatcacctgacccgccgggcgggagaagttgatggcgaaagtaccaatctgaccgccgaggtagtcaacgttgaacaccagttcctgcggcagcgcttcttcatcacgccagataacccagccgcagcccagcggagccagaccgaatttatggcctgaagcactgatcgatttcacacgcggcaggcggaagtcccagacgatatccggggcgacgaacggtgccaggaagccaccgctggcggcgtcgatgtgcatgtcgatgtcgataccggtgtcggcctggaatttatccagcgcatcgtgcagcggctgcgggaactcatagttaccggtgtaggtcacgccgaaagtcggcaccacgccgatggtgttttcgtcgcaggcttcaatcatgcgtttcgggtccataaacaactgaccggggcgcatagggatctcacgcaactccacatcccagtagcgggcgaatttatgccagcagatttgtaccggaccgcacaccaggttcggtttgttagtcggcttacctgcagcttccatacgcttgcgccaacgccatttcatcgccatcccgccgagcatacaggcctcggaagaaccaatggtgttggtgccaacggcctgaccatttttcggtgcaggcgcatgccacagatcggcaaccatgtttacgcaacgcaggtcgattgcagcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctgaaatgcaacatcatcgcgcatttcgtgcagcggaaatcgttttgattctgcgatagtagaaatggcctttgcgccaaaacgtgaatcgagtagttctgagcggaaatccgttaacagcttctggtccatttcgaactccttaaatttatttgaaggcaataaaaaagtaggatttatccgcaatggaagcaaggtattacaggattaatttaaataacaaaatcctaagcagaaaaacgactttttataatataaacatttaatatgataatattaaaaacagactttattatcgtaataaaaatcgcccaaacactcctgttcgggcgatcaaattaattattgtttatcctgcatatacggcgtgtaaaccccgttcagactgtgcaggaaagcgacgatatcatccacatcctcctgcggcagctctttgcctacctgatagcgcagcatcagtttcaccgccccgtccagcgtcggcacgtcaccgcgatggaagtacggtgccgttaaagcaacgttacgtaaaccgggtactttctgacgcaatttatcacgctcttctttagtaacattcatacgaccaatatccgccgccgtaatttcaccaaagttaaagtcttttttcagccccaacggttcaaaggaacgtccgccgagaataataccaccatgacaagttgcacatttattatctttaaataattgatagccttttttctgttgcgccgtcagagcattctcatctccacgcaaccatttatcaaatggggaatccggcgtaattaatgttttctcaaattcagcaatggcatcagtaatattttcgccactgaaaccttgcggatagacttcgaggaactgcgctttaagctgcggatctttttccagcttagcaataatttcgtcccaggatttcgacgccatttcaatcgggttcaacggcggtccaccagcctgatcctgcaatgttgccgcacgaccatcccagaactgctcaacgttaaatactgagttaaataccgtcggcgcgttaatcggcccaactgcgccaccaacaccaatcgatgtttttctgctatcgacgccccccgcattcaacgcatggcaatgagcgcatgaaatggtgctatcagccgataaacggggatcgtgatacagcgcaaaacccaacgccactttttgcgcatcggtaggcagtttttgcgggatgggctgcaccggttcattgcgatgctccggagcagtatcattgctggcgtaatattccgcgcgctgttttgcaatccaggccagtatttccgcccgctcttcatcactcaccttacccgcccagtgaagcgcggtataacgcgttggcggcatagtttcatactgcatcacccattcaatcttattcagatcgctttgcgaaacgggtttattagccagcagagccgcacgcacggcctcgaggttaaaagatttatatccaagctttatgtcgtaatccatcaactgtttcgcgccgggaatataataataggcaggtaattctgccgaaggcgtatggcaataatcgcatcctttttcgcggagaaagcctaaaaccttattattttcactgacagcagatgcctgaacatcggcctgtttactgcgtttattatcgtggtaccacacataaccagataaccctaaatagcaaatcgcgacgccagccaggccgatcgcggtaatacgtgagaccattttcattattcttccctcacggtggtgagttattgtgacccagaaaattttccagaatgctgcaaacgtctctgcgagacaaagccatcataaaaaacagggagatatgctttttgataggaatcaatcaattacatgaatataaactatcaataagatagccagtgcctattatccagctcaggaatggcatatcatgattgcggcgagagcaggattgaatgttctgaaaatgaaaaacaacacgaaatccgtatttttataaattccattgatattagtgcgttatattttttggcaggttaataaacgtgatccaccgcacgctttgtcgcccaccaggcggagcgaatgactacccttaaagaaaagcccgataattagcgacgaatttcggaggtcggatccttatgctcaatcagaaaattcaaaaccctaatccagacgaactgatgatcgaggtcgatctctgctatgagctggacccgtatgaattaaaactggatgagatgatcgaggcagaaccggaacccgagatgattgaagggctgcccgcctctgatgcgctgacgcctgccgatcgctatctcgaactgttcgagcatgttcagtcggcgaaaattttccccgacagtaaaacctttcccgactgcgcacccaaaatggacccgctggatattttaatccgctaccgtaaagtgcgccgtcatcgtgattttgacttgcgcaagtttgttgaaaaccacttctggctgccggaggtctactccagcgagtatgtatcggacccgcaaaattccctgaaagagcatatcgaccagctgtggccggtgctaacccgtgaaccacaggatcacattccgtggtcttctctgctggcgctgccgcagtcatatattgtcccgggcggccgttttagcgaaacctactattgggattcctatttcaccatgctggggctggcggaaagtggtcgggaagatttgctgaaatgcatggctgataacttcgcctggatgatcgaaaactacggccacatccccaacggcaaccgcacctattatttgagccgctcgcaaccaccggtttttgcgctgatggtggagttgtttgaagaagatggtgtacgcggcgcgcgccgctatctcgaccacctgaaaatggaatatgccttctggatggacggtgcagaatcgttgatccctaatcaggcctatcgccatgttgtgcggatgccggacggctcgctgctcaaccgttactgggacgatcgcgacacaccgcgtgacgaatcctggcttgaggacgttgaaaccgcgaaacattctggtcgcccgcccaacgaggtgtaccgcgatttacgcgcgggggcggcctccggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcactgttccgccagaaggccagtgcccgtcgcgatgcggtaaaccgttacctctgggatgatgaaaacggtatctaccgcgattacgactggcgacgcgagcaactggcgctgttttccgctgccgccattgtgccgctctatgtcggtatggcgaaccatgaacaggccgatcgtctggcaaacgccgtgcgcagccggttactgacacctggcgggattctggcaagcgagtacgaaaccggtgaacagtgggataaacccaacggctgggcaccgttacagtggatggcaattcagggatttaaaatgtacggcgatgaccttctgggtgatgaaatcgcgcgcaactggctgaagacggtgaatcagttctatctggaacagcacaaactgatcgagaaataccatattgccgatggtgttcctcgcgaaggcggcggtggcgagtatccgttgcaggatgggtttggctggactaacggtgtggtacgccgtttaattggtttgtacggcgaaccataatatttttacagccagccgctaacttcctgctggctgtaaaattatcctcttcaggaggagatatttaacatcattgccgcctgggtgcgatttttgacttccagacggcgatacagtgattccagatgcgcttttaccgttccggtactgatattcagcgccctgcctatctctttatttgattcgcccgccgctaacatggttaaaatctcccgctggcgggcgcttaacgatttgagatctttaatgtccttttccggcgtcgttcgccagtctccaggcagaaacatcatccccatcgccgcactatttaccgccaacgcaaatgtctcgacggttgaatcacgaggcacaatggccagcacattaaaatgaataacttcctgtaaccaccgtttgttgcaatccgtcgccgtaattaacaccttaacctcaggaaattgcaccgcggttttttgcagcaaccagtagcaaaactcaccatcctgatcgccatcgagcatcactaaggcttcagggtaactttccagcttttgccataactcgtctgcctgactggccccctgaatactcactcctggaatacgatgctgtaaactgattttcattccatgaataaatattgactgcctgtcaaacatgactatttgcataactgaatctccacctgaatacgttaaaaagacttaagtagtggaagggtattacccgcgagaaaaaataagaattcgccatttggcggtggccattctacagagatgacgcgtagaaaatagttaccgatataaatagttacagctaaacgcctgaaattacatgtcgagggcactatttaaaacatttttgaggatttccttatatcggtagttagtacgcatgcaattaaaaatgaaattccgcgaccataaacaaaaataacaaacggcaatgagataaaaataagcacaaatagccaatacatcttctattcactttaaagggaatcgctgaaaaatacgctctgtttaagggaattcacctttctcataaagctattcctcccttttcctgctgagaaatcgccacattcatcatgacaacattgtgaaacccggcattagatgttagaaaaaacaataaacaatgcgatatgcgcgctactgtttcgttgtgaacaacaatcggtcaaagaaatggataaaattcacgcaatgcagttgttcatcaaagtcgcggagctggaaagtttttcccgcgcggcggatttctttgctttgccaaagggaagtgtttcgcgccagatacaggcactggaacatcaacttggcacccagcttctccagcgcaccacgcgacgggtcaaactcacgccagaaggcataacctattatcaacgggcaaaagatgtgttgagtaatctcagcgaactggacggtctgtttcaacaggatgccaccagtatcagcggtaaattacgcatcgacatcccgtcaggaatcgcgaaaagcctgttactgccgcgcttgtcggaatttctctatctgcatccgggaattgagctggaactgagtagccatgaccgtccggtagatattcttcatgatggttttgattgcgtgatacgcactggcgcattaccggaagatggcgttatcgcccgttctctcggcaaactgaccatggtcaactgtgccagtccacactatctgacgcgctttggttatccgcaaagccccgatgatctgacttcacacgcaatagtgcgttatacaccgcacctgggtgtacatccgttaggttttgaggttgccagcgttaatggcgtccagtggtttaagtctggcggcatgttgacggtaaacagtagcgaaaactatctcgccgccggtattgccggtctggggattattcagatcccgcgcattgccgtgcgcgaagccctgcgtgccgggcggcttattgaagtgttgcctggctaccgtgccgagccgctgtccctttcactggtttatccgcagcgtcgggagctttcccggcgtgtaaacctgtttatgcagtggctggctggcgtaatgaaagagcacctggactgaccgactatactttttaagaataaccacgacagaaggacaaaagagcggatgacgcaggaaaacgagatcaaacgtcccacccaggatctggagcacgagccgattaagcagttggataatagcgagaaaggcggcaaagttagccaggcgctggaaaccgtcaccaccactgccgagaaagtccaacgccaaccggttattgcgcacctgattcgcgcgacagaacgctttaacgatcggctgggtaaccagtttggggcggctatcacctatttctcatttttgtcgatgatccccattttgatggtgtcgtttgccgcagggggctttgtgctggcctcccatccgatgttgctacaggatatcttcgacaaaattctgcaaaacattagcgatccgacgctagccgccacgttgaaaaacaccatcaacaccgccgttcagcagcgtacgactgtagggcttgtcggtctggcagtggcgctttattccggcatcaactggatgggtaacctgcgtgaagcgattcgcgcccagtcacgcgatgtctgggaacgctcgccgcaagatcaggagaagttctgggtaaaatatctgcgtgattttatttcgctgattggtttgttgattgcgctgattgtgacgctttctatcacctcggttgccggttctgcgcagcaaatgattattagcgccctgcacctgaacagcattgagtggctgaaaccgacatggcggttgattggcctggcgatttccatcttcgccaactatctgcttttcttctggatcttctggcggttgccgcgccaccgtccgcgcaaaaaagccctgatccgcggaacatttctggctgctattggttttgaagtgattaaaatcgtgatgacctacaccctgccatcgttgatgaaatcaccctctggcgcagcatttggttccgtgctggggctgatggcatttttctacttcttcgcccgtttgacgctgttttgcgcggcgtggattgccaccgccgaatataaagacgacccgcgaatgccggggaaaacgcagccttaaaataggccggatgcggcgtacgaatttattcggcctggctccccgtaggccggataagatgcgccagcatcgcatccggctataatgcgcacataacctcttgaaactctttcccagagcctctttagccatctattcaggagcaaacaatttcattccaactcataaccccagcatataaatccagttggtaacttttatttaacctaaaaccagtttaatccaccatttataaaattatgtgaagcatttcatagaagaaaaatcactggcctaaacattatcccctttttgcatgatttttgaccatttccgcgatttgttacacattgaaatatcacttttgctgtgcgtaatatggctattcgttagccaaaaaataagaaaagattatgcaagcaacagccacaacactcgaccacgagcaagaatacacgccgatcaactcgcgtaataaagtccttgtcgcctctctcattggcacggccattgagttcttcgacttttacatttacgccactgcggccgttattgtgtttccgcatatcttcttcccgcagggcgatccaacggcagcaacgctacagtcgctcgccaccttcgccatcgccttcgtcgcgcgccccattggctctgccgtttttggtcattttggcgatcgcgttgggcgtaaagcgacgctggtcgcctcgttgctaacgatggggatttcgaccgtggtgattggtctgctgccaggctatgccacgattggtattttcgccccgctgctgctggcgctggctcgatttggtcagggtctgggcttaggtggtgaatggggcggcgcggcgctgctggcgactgaaaacgccccaccgcgcaaacgtgcattgtacggctccttcccgcagctgggcgcaccgattggcttcttctttgccaacggcactttcttgctgctttcctggctactgaccgacgagcagtttatgagctggggctggcgtgtgccatttatcttctcggcggtgctggtcattatcggcctgtatgttcgcgtgtcgctgcatgagtcgccggtgtttgagaaagtcgctaaagcgaaaaaacaggtgaagatcccgctgggtacgctgctgaccaaacatgttcgcgtaaccgtactgggtacgttcattatgctggcaacctatacgctgttttacatcatgacggtctactctatgacctttagtaccgccgccgcgccagttgggcttggtttaccgcgtaacgaagtactgtggatgttgatgatggcggttatcggttttgcagtgatggttccgttggcgggtctgctggcagatgcttttggtcgccgtaaaagtatggtggtgatcactacgcttatcattctgtttgccctgtttgcctttaacccactgttgggttctggtaatccagcattggtgtttgttttcctgctgctgggcttgagtttgatgggcctgacctttggtccgatgggggcgctgctgccggagctgtttccgacggaagtccgttataccggagcatcgttctcctataacgtatcgtcgattctcggggcgtctgttgcgccgtatatcgcggcctggttgcagactaactatgggttaggcgcggtggggttatatctggcggcgatggccggactgacgttaattgccctgctgttaacgcatgagacgcggcaccagtcgttgtagtcgttttaactgccggatgtcagacatccggcaactatcatcacttcttcatctgcgacaaaattgtccggcactgattagcctccccttcggaaggtgagatcagtgccagcaatgctgccgctggcgtaaccagcgttgccagtgccgccgcaacagcaccacgggcaatcaacggcccggctttcaccccagcctgcggatttttaaacgtcccacgcacatacagcggcgaacgcagcgtgataatgcgaatccctttactttctggatcgatagttaaatccagctgttccgaagcaaaacttgccgtgccggtaacattgatcaacgcattctcggtatcaaaagcgaaaacctgcggacgcgccacaccgttggcaatatccagattcgctgccgcgcagttcacccgcacctcatcgtcaccaaatatcgcaccgacaatgtagttaccaacattcagcccgacaatctccatcaggttgcggctcaccagcccgtcattcatcaacagtttcaggttgccattactgttgcctaaaagcgccgccaccgagttaccgctaccgcgtagttccgcgtcaccgttcatttcccccagcgtcttctgcatcagttccacatccggcatcagttctttcagtttcagtcgacgagcctgaatatctgcccgcccctgcatcggctttttatcgccttccagatgaatattcgccgcaatgctgccgcccgctatgccaaatttcagcggttgcaggcgcaggtcagcatttttgaggatgatatgagtagaaagatcgctaatcggcaggctgctgccatgctcaatgcgccgccctttgaagcgaacatcggcatccataacgtcccatttatcggtttcgaagcggtcataaggcagcactttgcccgcaggctgaacgcttttttcgcccttcttctgttcagaccgtttcgacttttctgcccctttcccggaatcaacgccaatcaacggtcccaggtccgccagccgcaattgccgcgactcgacatcaccttccagttttggtcgtggcttgccggtggtatagatcagagaaccgtggatatcgctatcgccaatgcgcccattaaaaccgcgataatcaaagaccgacgatttttcagtgtcgattttcgctaccagccgaccatccgtttcaaacggcggtgtatcgggcagcagaacgcccgtcagttcatagagatcacccagcgaatcgccagaaaatttaagccgtaaatcgacaccccccatcttcattgggtcattcacaacgccatcaaaagcaacacgggtgttaccagagcggaaatcagcctgtaccggaaacggcgttccttcgccacgcagcgccagcataccgcctatttttcccgtaccagtgagcggttcaccgttataacgtccctgcgccttcaggccaaaaacgtaatcgcccaccttttctttatccgctttacctttcgatccggtaacttcgctgaacggcagcggcttgcctaacggatcgacaaaaatttccagatccgctttgcttactttgtcatcaatggcgatccgcccttgatcgaaaagaatattatccagctgaaacgaccacgccgacggctttgcattcgcgtctttgttgtcatcgttggcgagattaaacgtccagttattgttcttttcggagaggcgaatcaggcgcgcgtcgggcttttcgagcttgatccacggcaaccagaccgttttggtcagcagcgccagcggggccagcgtcgcttctactcgcggcaaatgcaccattgtgacttcgggaatatccggtggattgccaagaatgatgtcttccgcgtgtacatggggccacggcacccagctgcgccagccagtttcttgtttttgccgctcccacaccacgcccagatcgccacggatagcgaacggacgattcaactccgcagagactttctggttgatggtcggtttgagtcgattccagtcaaaagttgcaatcaaaatgatcgccacgacaatcaacaacaagaaagcccctgaaatcgcagcggttattttgcctgccttgctcatcgttcgcttcctcatattcttcctgtgccagtcctaaagatagtccagccaggcggaaaatgaggcaacttatagcgccagaaccgccgtattcagcgtttctatcggtgccgggcgtgaaagaaaccagccttgtgcggcgaatgcgggcgagttctgaacatcacgccactcttccggtgtttctacgccctcgacaatcaccccgcgacaatagcgattcattagatgtaaaagctgagaaaagagtgtgcgtccttccggcgactgacgcagcatcacaaacagttctcgcgcgattttgatgtagtcataacgcacttcacttagtgcagagaaatttgccatcccggtaccaaaatcatccagccacagcgggccaaattcacacatcgaggcaaaggttgaatctttcggcaggcggatgtgttccaccagttcgaaacgcagccagggaagatcctcaatctggcgcaggatttttggttgctgacgcagggcgatgagcgtagggccatcaatattgaccgatgccagcaggccgtgctctacaaagaagtcggctttttgcgccagcaaatcaatctgctctttcacaacctccatccgatggctaacggtgatttcagtaaaatagcgatccggcggcaggcgttgcgaagggttcaagggatgcgtgaccaccgttaatagctccacggccattaaccgcccgcatgtttgatagatcggctgccaggtgtaagcacgctcacactgcaaccaaaaacgccgttcctgcaagctctcgatgcttgcttcagggttgcttattcgctggataacctgccttatcatcaaagatgtcctgtgtttaaaagtgatgctgcccggactcgacaaagattatcggcgcgcaagggcagaactttaccgcctggccggggtaaatttccccactccacaacggaatctttcaggaatacgttctggctcaaaaaaataatggaacactgttttaatatggttgaccagcaaaccaccacagcgcaaactaacgctaattttttacagatcaggttcacgactatgtccaaaaagattgccgtgattggcgaatgcatgattgagctttccgagaaaggcgcggacgttaagcgcggtttcggcggcgataccctgaacacttccgtctatatcgcccgtcaggtcgatcctgcggcattaaccgttcattacgtaacggcgctgggaacggacagttttagccagcagatgctggacgcctggcgcggcgagaacgttgatacttccctgacccaacggatggaaaaccgtctgccgggcctttactacattgaaaccgacagcaccggcgaacgtacgttctactactggcgtaacgaagccgccgccaaattctggctggagagtgagcaatccgcggcgatttgcgaagagctggcgaatttcgattatctctacctgagcgggattagcctggcgatcttaagcccgaccagccgcgaaaagctgctttccctgctgcgcgaatgccgcgccaacggcggaaaagtgattttcgacaataactatcgtccgcgcctgtgggccagcaaagaagagacacagcaggtgtaccaacaaatgctggaatgcacggatatcgccttcctgacgctggacgatgaagacgcgctgtggggtcaacagccggtggaagacgtcattgcgcgcacccataacgcgggcgtgaaagaagtggtggtgaaacgcggggcggattcttgcctggtgtccattgctggcgaagggttagtggatgttccggcggtaaaactgccgaaagaaaaagtgatcgataccaccgcagctggcgactctttcagtgccggttatctggcggtacgtttgacgggcggaattgcggaagacgcagcgaaacgcgggcacctgaccgcaagtaccgttattcagtatcgcggcgcgattatcccgcgtgaagcgatgccagcgtaaaagcagcatatgcaaaaggctggatagagtgttacccctctatccagctcatccataaatacctgatggttgtgctaactcatcaccatcaggcattactgtacaggtggaatatccgtcacttcaggatgtacgtcatccgtggcgacagatgtggcggcagccgcagtcgatggggccatgatttgatcccaggccgcctgcaacgctttcatgttaaattccggctcgcctttcggctgcagcagtattaacgccatatcattcgacaactgctgacgcagatcctgatttaacatctccaccgtcaggctgttaaggaaatcctgacgcagtttctgatattgctccggcgcgatatcgacgacctgattttgcaacgaacgcatccgctgccccatcagaatatcggtatcagctcgcgcataggcggcaaacagtttctgcagctccagtttcttttgcgccactaacgcattgaactcttcttccggcagacctttatcgcgaaccttcgccagttcacgcgccaccagattaaggttgctgttcagcttgtcgtttggtgattcgatgttgatggcacactgcgcacgcagatacagcacacgacagtcaaatccaagaccgatgtctttactgttactggcgcttaacgcttgctgaacatgccagaacagcgcctcacgggccaggtccgcacgccagtagcgcagcagtgcggctgattcacgaatcggctgccacggcgtatcccacatgatagatagccggtcctgacgcaccgcgtcggtcataatactcaccgcttccgcacgcagcggagaaagcgtcggcaccggagccggtgtttcacgtttgcctttcagttcgccaaacgttttattgatttggtcgacgaccgagcgcgcatccacgtttcccaccaccagcagcgtcattgcatccggggtgtaccatttctgatagaaatctttaatcttttccgcttcaacgggttgtttcagcggatcggcaggatcgtgacctaacaaggttgatcctttcagacgataacgccaccagccctctttagtatcggcaggccaggttgccaccatgtcctgactttgcaacgcatggttgatggtttctggcgtgatagtcagtttgccagtggcatttgccagataagagagcgcctctttcagcaagtcgttacggttattgggcaaactcagattaaacagcgtggtgtcataagagacaattaccggcggcatcgggcgtttagggtcgatcccctgctgccacaatgaacgcgcctgcgctgcgtcaaggccaccgctttgcgttagcgcaatacgagggatggcgtgactgtaaccgctctgttgtgtactttcggcgagcgaaccggtattaaccagcaggcgaatttcaacacgatcgctgggacgttggggcgtagtcagcacttgccactgtaaaccgttggaaagcgtcccctgttgccatgctggatcaggctggagcgcatctgcctgcacatagccagcagtggccatcatcagcaaaccgcccgctaaaagtcgaatttttgtgccctgcatgtgaacccctgatcaactatcctggtaataaaaaactgcccgttgtcggtcagtctaaatgacgttaaaaacacttcgtgttagaccgcaagaacatgaaaatgtcacggaagaagtgaaataaacctgaactcacccaggtggtaagttcaggcacaggggtcaattatgcgcaaacacccgcactcggggaagggagtgcgggcataagtggtgagattaagaggataattcgtgcgttttgccatccggcgcacgattattcagcacatcgtccagttttttgtggtccagttctttcacccacttagcaacgacaatggtcgctacgccgttaccgaccaggttagtcagcgcacgagcttctgacataaagcggtcgataccgaggatcagcgccagacccgctaccggcaaatggcccaccgcagagagcgtcgccgccagcacgataaaaccactacccgttacccctgccgcccctttagaagaaagcagcaacacgattaacagcgtgatttgatggacgatatccatctgactgttagtggcctgggcgataaacaccgccgccattgtcaggtatatcgatgtgccatcaagattaaacgagtagcctgtcgggatgaccagccccaccaccgatttgcggcagccgagtttctccatcttgtcgagcatacgcggcagcgccgactcggaagatgaagtccccagtacaatcagcagttcttcacggatgtaacggataaatttgaagatactgaaaccagtcgctttagcgattgaacccagtaccagcaccacaaacaggatacaggtgatgtagaagcagataatcagctgccccagttgcaccagtgtgccgacgccgtatttaccgatggtaaacgccattgccccgaacgcaccaataggtgccagacgcatgatcatattgatgatgccgaaaatgacctgcgagaaactttcgatcacgttaaaaatcagttggcctttgctgcccagacggtggagcgcaaaaccaaacagtacggcaaacagcagtacctgcagaatgttaccgctggcaaatgcgccaatgacgctcgccgggatgacatccataatgaaggcgacaatgccctggtctttcgcctgatcggcgtaaaccgctaccgctttcgcatcaagcgttgccggatcgacgttcattccggcaccaggctgcacgacgttaacgatgataagaccaataatcagcgcgatggtactgacaatttcaaagtaaagcagtgcgactgcgccggtacgaccgaccgccttcatgctttccatgcccgcaatgcccgttacgacggtacaaaagatgacaggagcgatgatcatcttaatgagcttaacgaagccgtcgccaagcggtttcatttgctcgcctatttcaggatagaaatggccaaggagaataccaatggctatcgctgtcaggacctgaaagtaaaggcttttaaacagagaggttttcatagggtgtcctttagtaaaaccacaggtcttgtaaggttatggggtacctgcggccttaaaataacacccagacaacatcacagaaatgtacctggatcataattgaaacaaaaaggttaaaaagtttgagctggctcgcacaaaccagcactttttaaagttttgtaatcagtttggggtagctacttttcttccaggtaactctcttcgaagatttcaatagggagtgggcgagcaaaaaggaagccctgggcaataccaacgccagcttttgccagccagtcgcgttgtgcttcagtctccacgccttcggcaatcatttgtaggttcaggctctgcgccagcatgataattgcagcaatcatgctgctatcttccggcaaaccttcaacaaacattttgtcgattttcagtacgtcgattggcaacgatttcatatgctgcagctgacgcagccctgcgtagcccatgccgaaatcatccagcgccacccgaactccggcattgcgcagcggacggaggattgccaccgcagcatgaggatcgtcaatacgtcggctttctgtcacttccagaatcagtgttcccggctgaatacgatagcgggttaacaattccagcatatccgccaccatatttggatgcatcagttgcagcgctgagaggtttaccgacaagggcagcataatgccgcgctcttgccaggcagcaagcaatcgacaggactcttccagcacccagtgaccgacggtaaccatcagcccacagcactcaatgcgatcgattaagccatcgggcaggtcccaactgccatccggttgctggatacgcagtaacacttccgcactgaccagtttaccgctggtcatctcgacctgtggctgtaaccaaatcgcaaactgatgattttccagtgcattaaggatatcgctctcttccgtcaaccgctgctgggcggcttccatctgctgcggatcaaagaactgaatctgatttttgcctttatggcgagcggtaaatgccgcagaaatagcgcgactgtaaagctgttcggcggtgagatcgccgtagaacatcgccacgccaatgctacagtgcggacggagttgaatacgttcaatcggcaggcgctcgctcatgatagtgagcacttgctgacctaatgtgatagcgtgccacggttcctgtacaccgttggcaatgacagcaaagtcataaccgctaatctgcgcgaggatcatgcgtggcgacagtaccgatttgagtttttccaccagcgtcagcagcagaatttctcgttgcgcctctttcagcacacccgcagtatcacgcagggtttcacaggtgatgatcatcagcgcggtagtttgtttacgcgccaccacctgctccagcatctccatcagcaaggctttgttcggcaaatccgacaccgggaagcgcatcgcattttcgttctgttcttcataatggcgctgcagcaattgctggttgaggttgtaactgcgcaccaacataccgatttcatcgtcctgatgcagacgcggtaatgccagttggtgaccaacaagctcctggggtgggatggcgttaagttcgcgagcaatattgcgtaacggatgcaaaatcaggcggttaatgcaccagctaatcgccaccgtcaatattaacgacaaaagtaagtaaatggtcactaacgttgagagggtgctcatcacgaacttatacatgcggaaggaatccgcctgtaacaccagataggcaattggctgcgggtttgccggacgttccagcgagtaaacgcccagcgagatttgcaccggtagctcaaacaggcgagtaaccattaccggcaccggacgctctggaataaaacttttacgcagcgcctggaactggttaggcagcactacatcggcacggctgaccacgcctgccggtttaatgctggcaagaatagcttccgcttcgggaatatcgcctttcaaaatggcagaagataagggttcgcggacagagcgagcaatgctttccagttgcgtagccgtgttatagcgattctgctggaccagatggaacagcaaaacggtgcaaaaaataaaaacgaacaccaggacaacggctgccaccattgccatctgcttgattgttaacgagcgacttacgcgcaaattgtctccccccggaaatcccagattgccgcccgagtatacccgatcgcagcggcattaagagaggcgctatctgaaaacttaccagtcggcgtaaggtatcagcggctgcggcggtaaatccatgtcaccctgccatccggcggcggaataacgtacgtagagcaggaaatggctgggggcgtaatcttttgcctgctggatatcaattgccgtgccgacaaaccagttggaagtaacacgtcgttcaagtaatgcccgcgccgtgtagccaaagccctgactgctgccgccatcgttggattgccgcgcagcttcttcctgccagtcggtcgggatcagattcatcagcggataacgcggcatggttttggtgcgtgaatgcgaccacgagccagacgcccccagctcccacgaccagttttccgtgcgctcccgccacatcaccggtatggcaaacgacaggtattcctgcggactgtagtaaccgccctgaccgagtgagtagccactcaggtctttgtcataatgccagatcatgttgttcaggccgattgtgacgcggcgattgttctggttgatgaccttatagtaatagcccgtcatccagcgcacgcgccagttatcttcgacatttttaccggttaactgatcaccgctaagcgatgcccagacgccgtttgcttcacctttatcgtagctcagacttagccccacgccgtcggcacgcacgccgccccattttttcccggtattgctcggagagtctttttgcccaccaaaggccagcaaagaactggagataggccgacggtgggcgttaacggtgtaacccagcggcccgatatcatcgctgtaactgatgccgccgaccacatccaccacgttgaagcccatcggcgtggtaccgatatcccagctccagacgtcatttcgccagccgaccgccacgctggcaccggaatccgactggctgcggttgccgctacagtcctgtaatgtacaggtgccccagttgtcatcccatttgccatcggcattagtggagaaactgccgacgttcatattgacgaaatcactgcgaaagaacatccgcccgtcagaatagggcgcgtccacctgcaacatagtggtgtgcgctttcagatcggagtaaccaccggtaccgctcgaaccccagtaatcgtgctcgagagtgacgttaagatcctgctggcgatagaggtccgccgtatcgctgcgcacgccgcgtttcagccagtcatctttctcgtcgttacgggtcagccgggtaaaggtgtcgttatcctgcggacgcgtcgtggtcacaccggatgcaaccatagcgtctttgtaggtttccagcgcctgcgttggatcgcccgccagcgcttcaaacttcgcaccatcacgcagtaccatcgcgctttccatcgacggtggctgagattttgcctgcgggatcaacttattaaatgtctgctgcgccgctgcggtatcgccaagctgcgcctgtgccagcgccacgcgccgctgtgtgttcagcgaggcgttatcaatggcaggcagtttcgccagctggctacgtgccgccgctttgtcaccggcagcaatatccacttccgtcagaccaagaatggcatcggcgttagttggctcccgcgtcaggacattctgatatgcagcgcgggcggcggtgtaatcacgtcgctgctgcgcccagtcagccagcgtgaggtcaatacgcgaggaaggcggttgctggcgcagcatcgcttccgcttctgcctctttaccgttttctcgcaggcgattagcggtttccagcacctgatcgttttgcagtcgattaaccagctcctgaatattgctgttccactgcccgcgcggcaggctgttgatatgcgccagcgccgctctgtcctggtcgtgaccggagaggtacagcccgtaagcgtaaacctgctccgggtcgttcggcttctgctgcgccagattgcgcattaacgtatcggcctggctgcgttgtccggcttgccagagatcctgcgaaagtcggtaagtaatccatacactgccggggtccagcgccagtcgttgccgctgaagtgctgccgcctgcgcccatttcccctggttttccagtgcctctgcctgctgtgccagacggtcgttttgcaggctgcgttcgatatcatcaatgctgcgccgctggctggcagagagcgaggcgatatacgcttcggctttttctggcgactgctggcggtaaatattcgccagcccgcgcacggcgttagtgttgccgctgtccatacgcaaggtctgctggtaatagcgttcggcggcgggataatctttgcgcgccatcgccacatcgcccagcccaagcactgcatagctgtcggtgttatcgacattacgtgcctgctggaacagccgttctgcccggtcaggattattggctttcagcgcggcatcgccctgctggatcgccagccagtagcggtttactttcagcaggctgttccatttgtcgttattgctgttgtgcggatccagcgcgagggctttttccagattcaccactgcattggcgcgatcgcctttctgggaatacgcctggcccagcgcccccagagcctcactgtctttcgggttcgcccgcaccgcctgttgtagttcgggaatggctttacccgccatgccagagtccaccgccgctaaaccttgcgcacgagcgcggaaagcagggtcggccagctgtttttgctgttctgccagttgcgattgtgcagcagccacgctatcgccatcgctaaagatcgagagatattttttcagtgcctgaacgctggcatcgctgacgggcatgtctttaatctgcccgtaccagattttagaggccccttcgcgcccggcgttcgatttcgccatctgttccaggacggcaaaaccttcgtcacggcgatcgctactaaacagtaatagcgccagattgttttgcaggcccgtattgcccggcgtatccgcattaatgcgttttagctgattaatcgcttcaccacggcgagccggaattttcgccaccgtactccagtactcgacagcaatgtcaccttccggcggcgcaccgttgaacagcttgttgtaactcgccacggcctcttccgcatgaccggtagtcgcctgcaatcgagcctgttgcagtgcctgacgaccatccggcgtagacagtaacattgtggtccgcgacgatttatacgcatttgaactcggcgctaactgcgacagccgatcgagctgtttttgtgcgccatcaatatcgccctgacgtaacagagaacgaaaacgggcagcaatcacatccgggttattcggatcaataagttccagccgatacaacgactgttgcaccaggtcttcacgatgggtcgcttcgcctaaccgaacttgctccagcaactgttgctgagcggttggtgctgcctcgaccatcggcatgacggccagaccgagggaaagcgtgaatatgtttagtgtgaatttgcgcattcctggccccagtcaggtaataactcaccttttgtcgagaagcggaaacggtgttgatcccagccttgtccaaacagggtcagcacatagttgtaataggcatcgctgccgggaaagttatcggccacgcgctggcgctgaacggcctgcgcatcgcggttttgtaaaaagggcagcatggcggcagaaaaaccgaccggtcctttaccctgcgctttccccgtagccacatccactttttccggcggataaccgtttttctcagtgaatgtcgccatcggtttaaaccggttgagcatccgcgctttttgcggatcgctgtcaggcatcatgcctacccacatgtaaacgcggatagcgtcgtagctgctgatcaatgttttttcggcttttagctgccagcctttgtctttctcatagcgcacccagtctggcgaaaagcctttcggggcggtttccagcaataaacgttgattggtttcgcgcagcgtggtccacggcgcgccaaagcgggtgaaatactgcgccagcgtcggcggcaggtagctggggttaaaacgccagctgttatcctcagcaaaacccactttgcccggtaacaacatggagcccagcccaggcaccgtcaccacttcctcccgcgcgatacgttttagcaatgcgctgccgatgtcggtataacgctgctctttccacaaacgccccgcctccagcaacgaccaggccatccagacatcaccatcggaggccgaattgctgtccagcacttcccacttactgttctctttcttgccccacagccaggcgggcaaatgttcttttaaagaaccctgagcgagattgttctgcgtccagtcgagaagattatcgaaagctgcacggtcgttagccgccagggcaaagaacatgccgtaactttgcccttcggaggtggtgattttgcgcgcgtcgctggggtcgatgacgcgcccttcctgactgatgtaatcctttttaaactgctcccaggcaggccaggtacaggctgcctgaacactaaaggcagccagcagcagcatcgtcacgagtccactacgcaacacattcatcttcaattactcgttatccgggttaagacgacgacgactaataatacgcagcagacgccacagtacccacgccagcaatatcacactgatagccgccagcaccgccagcagaatcggatggtttgccagcgcataccacaagcgctcgaaccacggcagatgacctacgtaataaacatcgccaacacgtaggctgttgataccggactcgcggatcaccgcgaccgaaccgaacatggtggcgcgtttgccgctatcgttcaccgcatcgttaagcatttcataaccgcgtgggctatctgccagcagcgcaatcacgctgcgctggtcgttatacggcgactggaaaccaatcaccgccgccatcgcaccggaagaggtcagcgttgactgggtttctgccgcgcgatcgctctcgtccggcacaataccggggaacggggtctggcgcatcggcgttttcacccagctttcggtagcctgcaccaacaggtcgatctgcttatcgtctttcagtttgtccgggataccaccgacgatcatgatgtcggcatctttgccctgaatggtgctgccatcatcggtcaccgtcaggttaatcgccgggaagcccgtctgcgcaccgataaagccaacggtattcagcaaggtttccatctgtgcttcgtttggcgttttcggcatcacggtgatggtttgcgacaaatccgccatccggctgaacgggaagcccgcgttagcaaaggcgcgtagatccggcatcgggatgaagtggtaatacttcgagaagtcgatggtggagtcgtcaccaatcaccacatgattctgcaccggctggaaggtaatgcagttatccaccgaaccgcccggcatcgggttcatatactcaaagtcgaaccgcagctggttggtcgcgcccagtttcagcgccggaatagagacatccgttttgccatccagcaaaccttgtaataccggaatccgcagcagcaggcggttcgcctcctgtttgctgctcaggttgaaggattgcaggaactggttattcaggctgatatccatccgcgaactgtctttcaccggcggcatggtgtagcggtaattaatatccatatcaatgccggtactgcgcatcaggtagagatccggcggcaggtttagcgaaacgttaatcgctgctggctcaagaccgctggattgtaattgttcttcataggttttcagttcaccaaaggtgaccggacgatcggtacgcacccagttcggcgcatcgtacggcttacgtggtagcagcggtttcacttcattcactaccacactttcaccacggaacagaatgttaccctgagcgatacctttcgctgcctgcaacaagtctttgtcgtcacgaccaaacaccaccagcagtttgacgtaaggattctgcggatggttaatcatctcaatcaccggggcttttaccgccggatgatcgcgcaggaagtccgggcgtttgtcattggtggcaaagacaatggcattgcgatccggcagttggttatagagcaccgggaagttctgcccacgccagcctgaacgcgaaccaaaccacgaggcgacaatggcagatgcttgttgcagctcaacatccggcgcacccgcaaagaccatcggcaaggtgttggtgcggttatcacgcgggtcaaagaatggcaccgggaagtgtgacaggtcattcttcacattcagggtctgataggtcagatccagtccactgctccgcccaacatccagccaaagcgtggtgctggccgggttttcgcacacgtcctgataatggccgacaaactccagccgcacacggttgaaatcagtaataaacagcgggttaatgggcatttgtgccagcgtttttttacccaactgttctttggtcactggcagcacgcccatcagttcatcattgagataaacctttaactgcgactggacaggcagtaatgatggcgatggcgtgtattcgaggttgagcatcgccttcgtcaccacttcatcgctgcgcataccaaactcaatgctgccgttcgggttaatgccacgtagcaccatgctgcccggcggcggcgcaatttgcgcaaaggtcagcttcacatcacgggaaggaccgttctgcgccacgactggcgcatctgcgccctgcacgcccggcatcacttgccccacctgcggattttgctccgcctgggcggttacagctggctcagcattgatcagtggttgcgttgctggcgtcgcctgcgtcatgaaagaggggaacgcactcatccccagagccactgcacaaatccagaatatttttcttttcatcgcgttatcatcattgttgagccaaagcctgatccgatggttgtgccgtttcgctccgctccgggcggcgcggaataaacgatacaacccaggaaaccagagaagtcagcacacggaatatgcccttcaccgaagaaggcgcaaattccgccagatggcggtagccacggaagccgagcttcagaatatccagcagactttccagcggcttatcttccgggtagctgtcctgccagagcgcccatgtatccgcacgggcaaacgtacactgcacaaaatcgatatgttgctgggtagtgagcggcattaatttcagcccaacttcattacccatcacgcgcgccacctgagccgggaagacgtattcctgctgaccgcgtttaagcaacagattcactttctgcccttccagaatctgcgcctgaccgttgatcttgatccccaaaccaccgtcggagaaatcctgaacggtacacgagaagaggtgaccatcttcgcgggcaattgctgcgggcatcgtcatctccacgcggtgcgatcggcgtacctgtttgctttctaccgatactgcgactgcgccgccgagaataatcaggttgtagaatacccacaccatactgacgaccacggtgagcatctcggttggcggaccatagaagtagcgccagatcccaaccgctacgcccaccaggttgagcagaacaaggaagatgtagggccgcgagatcacccagtcgacgtactcttcttccaccagtccacctttggcggtgacgttaaatttgcctttgtgcgggttaatcagcgccaccagcgtcggtggtgcgatataccacgccagcactgtttcgtagatttcactccagaaagagtggcgatatttgccctggatcttcgagttagtcaggctggcatggatcatatgcggtagcacgaacagggcgatcatcaacgctggcgcgtagatgatgtaggcatgaaacagcaggaacgccagcggcgcagtcaggaagatcagtcgtggaatgcccgacaagaaatggaacatggcgttgacatagcacagccgctgagcaaacttcagccctttaccggtgagcgggttatcgagacggaagatttgcaccatcccgcgcgcccagcgaatacgctgaccgatatgcgccgagagactttcggtcgccagccccgctgcctgcggaatacgcatatacgctgaggtgtagccacgacggtgcagacgcagagaagtgtgcgcatcttcggttaccgtttcgacagcaataccgccaatctcatccagcggcttacggcgaatcaccgcacatgagccgcagaagaaagtggcatcccacatatcattgccgtcctgcaccagaccatagaacagcgtgccttcgttcggtgttttacggaaacgccccaggttgcgttcaaacggatccggcgagaagaagtggtgcggtgtctgcatcatcgccagctgtttctctttcaggaaccagcccatggtcatttgcaggaacgatcgcgttggtacgtggtcgcagtcgaatatcgacacgaactcgcctttggcatatttcagcgcattgttgatgttgcccgctttcgcatgttcatgagtggtacgggcgatatatttcacccccacgttttgcgcaaactggcgaaactcttccctgccgccgtcatcgaggatccagatgttcagcttgtctttcggccagtcgatacccagcgaagcgtaaatggtatttttcaccacgttgagatcttcgttgtaagtcgggacaaagatatccaccgacggccacagcgacatatctttcggcaatggcaccggctgacgattcagcggccatacgacctggaagtagccgagcaccagcactatccacgcgtacgtttcagcgaacagcagaataagcccgcacaccaggctgaccggatcgtcccagtttaacgtcgaggtgtaacgccaccagatataacggcaagaaacggtcagcgacagcacaatcagcatcagcgccgagaagcgccccggcatccgccgtacgatcagcgctaccccccacagcagcatcaggaagataaactgcgctagcgggttaaacggctgagtaacgcagattaacgccagaatcagcgagaaggtgacgatgataccaaggatcaaccgccgcgccccggcactcaaatgaccgagctcttttttctcatcaagatgctgtgttttatggctaacgcgctcaggcagctcgttcatccattgatggtaacgtccacgaatattttgtagacctgaaaatgcccgcctgcgcggtttcggcgtttctttgcgcgatgcaccgatcagtaaccagcatgtttgaataagataacggaccgggtccagcggacgcggacgcgaggcgttgatatgcggatacaggtttttatgttctgcgcgaatacgctgccagcgcgggtgctccagcggaataaaaatccaggccaggatcatccagaaacagccgagcgtcgcgctgaaagccgacgcgccgtgacgacgataatcgcgataacgcccgataagccgtgcgttgaccggcgggataagcaaccaccgggtcaggatactcatgatgcactcccgactggcattttcagcccggaatagtttaacaggcaccagttagccagcgtcagtatctcttcagccgccagcgcatcactgcgatattcaccgactggttgcttagctgccagacattcagccatcgcttcatcacgatgaatgagcatcggcagcaatcggcgctggctttgcaaccaaagctggtaaatatcgtcctgaacctggctgccaatacggaagtcattaatcaaaatatgtgcaccatccggcagcgcttgctgatgcagtcggatatggcagttggcatccacattgacgattgccagcgagtgatcgcacaaactcagcagctggtgggttatctgcgaggcatcacgcggtaagtcaattaaaatccactggtaacgcccgctggcttttagttgctgtaagccggtgcaaatatcgctcagccgggtttgccagtgctgtggattttcttgttcttcaatggataactgaccaaaaggcagcaaatcgagctgcgaggtatagcgcaacccggcgtcacgccagtcctggccatccagcatagctctggcccaaccctgacggtgggtaaaatcaacgttaaatgacaggcgcaacaagttgtccgggcaggcatcgaccaccaggacattttctcccaacatttgtaatgaccaggctaatgcggcggtgatggttgttgtccccacgcctccccgaaccccctgcaatcccagtacggccattcaccaatcccctacttttgttgcgcaaactctgccagcaacggccagcgttttaatgccgcggccaactgttcgcgttgggaaatatcggcataatcaatatcaggcagtgaaaatgcctgctttaacgccaaaatatcattctggaagatatagcctatcgcgggatcaggcagagtatctggttcattgttattcatttttcttgatccctatgaaataaccgtaccgttcatgagacaattctaactgtgagcatttcgtcggtttattgtttacggcgagacgggaatgtgctcactttttgactttccgttacgcaacagaaaaagttaaaaacgaaaagactaaaatcacatgtcttgtgacctgctaaattgattcacatgctaaatctgataagttttaatttcaatggtaggtttatttcttagctttcgctagtaaactgataatcagacaaaatgttgacatgagggacattgtggaccctgtattctctatcggtatctcatcattatggaatgagctgcgacatatgccagcaggcggcgtctggtggtttaacgtcgatcgccatgaagatgctatcagtctggcgaatcaaacaattgcatcccaggctgaaaccgcacacgtcgcggtcattagcatggacagcgatccagcgaaaatctttcaattagatgattctcaagggccggaaaaaataacattattttcaatgctaaatcatgaaaaaggtctatactatttggcccgtgatttgcagtgttctattgatccccataattacctttttattcttgtttgcgcaaataacgcatggcaaaacattcctgccgagcggcttcgctcatggttggataaaatgaataaatggagccggctaaaccattgttcgcttttggtaattaattccggaaataataacgataaacaattttcattgttacttgaggaataccgttcactttttggtcttgccagtttgcgttttcagggcgaccaacatttgctggatattgctttctggtgcaacgaaaaaggggtcagcgcccgtcagcagcttagcgttcagcaacaaaatggttgctggacattagttcaacaccaggaggcggaaatccaaccacgcagcgacgaaaaacgcattctgagtaatgttgctgtactggagggtgctccgccgctatcggaacactggcaactgttcaacaataacgaagtcctgttcaatgaagcccgtaccgctcaggcggcgacggtggtcttttctttacagcaaaatgcacaaatcgagccactggcccgcagcattcatactctgcgtcgccagcgcggtagtgcgatgaaaatcctcgtacgggaaaataccgccagcctgcgcgccaccgatgaacgtttattattggcctgcggtgcaaatatggttatcccgtggaatgcgccactctcccgctgtctgacgatgatcgaaagcgtgcaagggcagaagtttagtcgctatgtgccggaagatatcactaccttgctgtcaatgacccagccgctcaaactgcgtggtttccagaagtgggatgtgttctgtaatgccgtcaacaacatgatgaataaccctctattacctgcccacggtaaaggcgttctggttgccctacgtccggtaccgggtatccgcgttgagcaagccctgacgctatgtcgccctaaccgtaccggcgatatcatgaccattggcggtaatcggctggtgctgtttctctcattctgtcggattaacgatctggataccgcgttgaatcatattttcccattgcctactggcgacattttctcaaaccgaatggtctggtttgaagatgatcaaatcagtgccgagctggtgcagatgcgcctgcttgccccagaacaatggggcatgccgctgcctttagcgcaaagttctaaaccggtcatcaatgccgagcacgatggtcgccactggcgacgaataccagaaccaatgcgactgttagatgatgctgtggagcgctcatcatgatgaccatcagcgatatcattgaaattattgtcgtttgcgcactgatatttttcccgctgggctatctggcgcggcactctttgcgacgcattcgcgacaccttacgtttgttctttgctaaacctcgttatgttaaaccggccgggacgttacgccgcacggaaaaagccagggcaaccaaaaaatgactcaatttacgcaaaataccgccatgccttcttccctctggcaatactggcgcggcctttccggctggaacttctattttctggttaagttcggcctgttgtgggcgggatatcttaacttccatccgctcctcaatctggtgtttgccgcgtttctgctgatgcccattccgcgctacagcctgcatcgcttgcgccactggattgccctgccgatcggctttgctttgttctggcatgacacctggttgcctggcccggaaagcataatgagccagggttcgcaggtggcggggttcagtaccgattatttaatcgatcttgtcacacgctttattaactggcagatgattggggccatttttgttttattcgtggcctggttattcctgtcacaatggattcgcattaccgtttttgtggttgccattctgctatggctgaacgtacttaccctggcgggaccaagtttctccttgtggccagccggtcaaccgacgaccactgtaacaacgacgggtggtaacgcagcggcaaccgttgcggcgacgggtggcgcaccggtagtgggtgatatacccgcacaaactgcaccgccaacaacagcaaaccttaacgcctggctgaataatttctataacgcggaggcgaaacgtaaatcgatcttcccgtcttcgctgcccgctgatgctcagccatttgaactactggtgattaatatctgttcgctttcctggtcggatattgaagccgccggattgatgtcgcatccactgtggtcgcatttcgatattgagttcaagaactttaactccgccacctcctacagtggcccggcggcgatccgtttactgcgcgccagctgcgggcagacttcgcacactaatctgtatcaaccggcaaataacgactgctatctgtttgataacctgtcgaaactgggctttacccagcacctgatgatgggacataacggccagttcggtggttttttgaaggaagttcgcgaaaatggcggcatgcagagcgaattgatggatcaaacaaatctgccggttattttgctgggctttgatggttcgccggtttatgacgataccgccgtgcttaaccgttggctggacgttaccgaaaaagataaaaacagccgtagtgccacgttctacaacacgcttccactgcatgacggcaaccattatccgggcgtcagcaaaacagcggattacaaagcgcgggcgcaaaaattctttgatgaactggacgccttctttactgaactggagaaatcgggtcgtaaagtgatggtggtagtggtgccggaacacggcggcgcgctgaagggcgacagaatgcaggtatctggtctacgtgatatccctagcccgtctatcacagacgtccccgttggggtgaaattcttcggcatgaaggcaccacatcagggggctccgattgtcatcgaccaaccgagcagcttcctggctatctccgatctggtagttcgcgttcttgatggcaagattttctccgaagacaatgttgactggaaaaaactcaccagtgggttaccacaaacagcaccggtctctgagaactcaaatgcagtagttattcaataccaggataaaccgtacgttcgcctgaacggcggcgactgggtgccttacccgcagtaagaacgaaaaaggccgcagagtttccccctgcggcctgatccgggcgcaaattgccattacggcagcctgacgcccgcatgacacgttacttccgcttattcagccagttcacgatcatactggcaagaatgccagcaatgaccggagccgctaaatcatgccagaaggccatgcccagttctgcgagcgtcatatagccgtctgtgttgtaatgacaacgtttcgcggctattcttgagttgttaaggttcaagattagcccccgtgatgttgtcaggtgcatacctgcaacgtgcgggggttttctctctccagcaaccaatgccaccagggattaagcccccgcaacattgcgcctcaccggaacccttccggcttgccgctgattctacgactgtttttctgttccggaatccgtcacttcttcactctgtgctgcgcattccgcagaatattatccgcttgcaaccgttgcatttttcttacgaaaaaggccgcagagtttcacctctgcggcctggtccgggcgcaaattgccattacggcagcctgacgcccgcatgacacgttacttccgcttgttcagccagttcacgatcatactggcaagaatgccagcaatgaccggagccgctaaatcgtgccagaaggccatgcccagctctgcgagcgtcatatagtcgcctgtgttgtaatgacaacgtttcgcggctattcttgaatggtctagatgcaagaatggcccccgtgatgttgtcaggtgcatacctgcaacgtgcgggggttttctctctccagcaaccaatgccaccagggattaagcccccgcaacattgcgcctcaccggaacctttccggcttgcagctgattctacgattgtttttctgctccggaatccgtcacttcttcactctgtgctgcgcattccgcagaatattatccgcttgcaaccgttgcatttttcttacgaaaaaggccgcagagtttccccctgcggcctgatccgggcgcaaattgccattacggcagcctgacgcccgcatgacacgttacttccgcttgttcagccagctcacgatcatactggcaagaatgccagcaatgaccggagccgctaaatcatgccagaaggccatgcccagctctgcgagcgtcatatagccgcctgtgttgtaatgacaacgtttcgcggctattcttgagttgttcaggttcaagattagcccccgtgatgttgtcaggtgcatacctgcaacgtgcgggggttttctctctccagcaaccaatgccaccagggataaagcccccgcaacattgcgcctcaccggaacctttccggcttgccgctgattttacgattgctttttaccgtcagcatccggcaatcttcctcattgcgtgatgccttccagcttaatttctttatttgcaatagttgcagctcatatccgggctgactccagactagtagtgaaatgcgcaattttgtagaattgcgcctcctcgcgacctccccagtgaatctgttgcctcattttttacatactgcgtattcgacttctccacctgttgcgcaagagaaactgggtttattcatttttgcgaggccgacttctttctggacaggactttatgcagcacaacacactaccgaaacacgatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtacaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttctcaatctctattttataaagtcgccattttcgccgtactggtggcgattgcgtctggtggtgaacgattactgtttaagatttccggaccaatggtggtggtcaaagtggggattattgtcgtgttcggttttgcgatgatcccgcactggaatttcgccaatataaccgccttcccgcaagcctccgactttttccgcgatgtcctgcttactattccattttgcttcttttccgcggtatttattcaggtacttaacccaatgaatattgcctatcgtaaacgggaagctgataaagtactggcaacccggctcgcgctgcgtacccaccggattagctatatcacgctcattgcggtgatcttgttttttgccttttcgtttaccttctcaattagccacgaagaagccgtttctgcctttgaacaaaatatctcggcactggcactggccgcgcaggtgatccctgggcatatcattcatatcacctctacggtactgaatatctttgccgtactgactgcattctttggcatttatctcggtttccacgaggccattaaaggcattattctcaatctgttaagccgaattattgataccaggaaaattaactcacgcatgctgactctggcgatctgcacttttatcgtcattacgttgacgatttgggtttcgtttcgtgtatcggtgctggtgttctttcagttgggaagcccgttatatggcattgtgtcgtgcctcattccgtttttcctgatctataaagtctcacaactggaaaaacttcgcgggtttaaagcctggatgattctgctgtacggcattttgttatgcttgtcgccactgttgaagttgattgagtaaaccggagcgcatggccccggttttgtgagttaacgctgcggattttcatcctgatcaacggcaaaacaggctaccagttgaccgccgtagtcttttagctgcggctgcaactggatgcaggggccgaagcgccgacgacagcgggcgttgaaggcgcagcctggcggtggattcagcgggcttggcagttcaccggtaagtttgatgcgttcgcgacgatcgtccgggttcaggcgtggtgtcgcggagagcaatgcctgagtgtacgggtggcgcgggttattgaagatttggtccttcgtccccttctccacgcagcggcccaggtacatcaccatcacttcatcagcaatgtgctccaccaccgacagatcgtgcgagataaagacataagatagccccagttcctgctgcaaatccatcatcagattcagcacctgcgcacgcactgagacgtccagcgcagaaaccggctcatcggcaatcaccacatccgggtcgagcatcagacctcgggcaatggcgatacgctgacgctgaccgccggagaacatatgcggatagcggtcgtaatgctcggttttcaggccgactttcgccatcatcgacagggctttttcccgacgctgttctttgcttaagctggtgttgatcagcagcggctcttcgagaatctgcccaacttttttacgcggattcagcgaaccgtaagggttctggaagacaatctggattttctgccgacgtagcttctgcgcctgcggatcgtgcttgagcagatcctgcccctggtaatacagttcgccgccggtgggcgtttcaatcatcgtcagcaaccgaccgagggtcgatttaccgcagccagattcacctactactgccagcgttttgccacgttcaaggttaaacgaaacgccatccagcgccttcaccagacgttccggcgcgaacatgcctttcttcaccggataatgttttttcaggtcgatagcctgcaacagcggttgttgcgaggtggcctcatgcgtactcatagtgtcggcctcccggcatcatcaagtgggtaatggcatttggactgacgcccgtcagcgagcatattcagcgccggttcttcagcacggcatttgtcagtggcgtaggggcagcgcgggttaagcaggcagccgttcgggcggtcgtacttgccgggaacgacacctggcaacgacgccagacgttctttgtcctgagcaaattccggcagcgcacgcagcaatgcctgagtatacgggtgacgcggcgcatggaagatagcgtgcgcatcgcccgtttctactacctggcctgcatacatcacgataattttatgtgccgcttccgccaccagcgccaggtcatgggtaattaacaccagcgccatgttctctttctgctgtagctccagcagcagttcgataatttgcgcctgaatggtcacgtccagcgcagtggttggttcatcggcaatcagcagttttggccgacaggcaatcgccatggcgatcatcacgcgctggctcatgccgccggaaagctgatgcgggtaaacatccagacgcgatgccggatcgggaataccgaccagatttagcaggtcaatcgctcgctgacggcgggtacttttgttgccgccctgatgcaccttaatcgcttccataatctggaaacccacggtgtagcacgggttaaggctggtcatcgggtcctggaagatcattgccacttcggcacccaccaggttgcggcgctctttttctgagatacgctgcaaatcctgaccgttaaactccagcttttccgccattacgcggcccggataatcaatcagccccataatcgccagcgaactgaccgatttaccagagccggactcacccacaatcccgaccacttcaccctgttttacgctgtagctgatgcggtctacggcgcggaacggtgcgctttcgtcgccgaaatgcaccgataatttatctacatttaataacgccatctcgaacctcttactgcttcagtttgggatcgagcgcgtcacgcagaccgtcacccatcaggttaaatgccagcaccgtcagcaggatcgccagacccgggaaggtcacgacccaccaggcgctttgcgcgaactgcaacacatcagagagcatggtgccccactccggcgttggcggctgcgcgcccatgccgaggaaaccaagagcagccatatcgagaatggcgttagagaaaccgagcgacgcctgaacaatcagcggcgcaaggcagttcgggaagatgttaataaacatctggcgcatcgccccggcacctgccacgcgagacgcggtaacgtaatcgcggttcacttccaccagcacggcggcgcgggttaagcgcacatagtgcggcaaggcaacaaaggtcagcgccagcgctgcgttaccaatcgacgggccgaaaatcgccaccagcaccagtgccaacagcagacttggcagcgccagcatgatatcgaccacgcgcatgatgatgttatcgaccaggccgccgaagtaaccggcgatcaggccgagaataacgcccataatcagcgataacacaactaccagacagccaaccagcagtgacaatcgcgcaccgtacatcagacgcgacagcacatcacggcctacgtcatcggtgcccagcaagtgcgccatgctgccgccttcctgccaggctggcggggcgagcagtgcatcgcggaactgttccgccgggttatagggtgcaatccagttggcaaagatcgcgataaacagcacgatgacgacgtaaaccagcccgacgaccgcgcctttgttgcgtttaaaatagtgccagaactcctgtaacggggtcatcggcaccggtgcgctaatcactttattttcagtaacctgtgacatgatgtccccttacttcttatgacgaatacgcgggttcaccacgccgtacagcagatcgaccagcaagttgacgaggataatcatcgtcgccaccagcaatacgccgccctgcactaccggatagtcgcggcgttgcagtgcgtcaatcaaccagcgccccagaccgggccacgagaagatggtttcagtcagaatcgcccccgccagcaatgttcccacctgcaggccgataacggtcaccaccggcagcatcgcgttacgcagcgcatggacgataatcacccgcatccgggtaagacctttggcacgcgcggtgcggatataatcttcgcccagcacttccagcatcgaggagcgcgtcatacgcacaatgaccgccagcgggatggtacccagcacaatggcgggcaggatcatatgggcgacggcatcgataaagttaccgtcttcaccccagatggcggtgtcgatcagcataaaaccggttaacggattggaatcatcgaggaacaccatgtcgctcacacgaccggagacaggcgtcaggttccagtgcaccgaaaccagcatgatcagcatcatgccccaccagaaaattggcatcgagtagccggtcagcgccaggccaaccgctgtgtgatcgaaaatggaaccacgtttaaccgcagccagcacaccaaccggaatcccgactgcggtcgcaaaaatcatcgcgcagacgccaagttccagcgtggcctgaaagcgcggcacgaactcttcccataccggaattcggcttttcatcgaaatgcctaaatcaccgtgcattacgccccaaatgtaatggagatactgctgccacatcggtttatctaagccgagttcagccagcaattgcgcgtgacgctctggggagatcccacgttcgcccgccatgatcatcaccggatcgcccgggatcatgtggacaaaggcaaatgtgagaagggtaataccgataaacgtggggatgacgagtcccaaacgtcggagaataaactgcaacataacccggattctctataatgacccgcagcctggaactgcgtgtctgtattgctcacaaatcaattcccgcccttgtggaacagggaatgaagtattgctgccggatggcgctgcacgcagaggcacagcgccaccgggtatggcttttaattattcgatagagacattttcgaagtgatgtttgcctaatggatcaaccacatagcctttaacttctttgcgtaccggttcaaacacggtggagtgagcgatgatcagtgccggagcctgatcgtgcatcacgacctgtgcttgtttgtacagttcaacacgtttattgtggtcgtcggtagcacgcgccggttgaatcagatcttcaaacggtttgtagcaccattttgagtagttggagccttgttcagaggcggcgcagctgaacagggtggcgaagaagttatccggatccccgttatcgccagtccagcccatcattaccgtctgatgctcgccatctttcgcacgcttgaggtactcaccccattcgtaggtgacgattttggcctgcacgcccactttcgcccagtctgcctgaatcatctccgccatgcggcgagcattcgggttatacggacgttgtaccggcattgcccacaggtcgatggagaaacctttttccagacccgcttctttcagcaaggctttcgctttttcaggatcgtaagtgtagtcctgaacgtcgtcgttatagccccacatggttggcgggatcaggtttttcgctgatacgcccgcgccctgataaaccgctttgatgatagcgtctttgttcaccgcgtaggtcagagcctggcgaactttcacgtcatccagtggttttttctgcacgttatacgagagataaccgacgttcagccccggcatttccatcaggttgatggatttatcctgcttcatgcgggcgatatctgccgggttcgggtacggcatcacctggcattcgttcttctgcaatttcgcgtaacgcacggaagcgtcaggagtaatagagaagaccagcgtatcgatcttcggtttggtgccccagtagccatcaaacgctttatagcgaatacgggaatctttctggtactgctgtaactggaacgggccggtaccgattgggttgaggtccagtttttccggtgtaccggctttcatcatcgcgtcagcatattcttttgacagaatagaggcgaagtccattgccaggtcagcgaggaacggcgcttccgggcgagtcagcacaaactgaacggtgttatcgtccacctttttcacttcgctgatcagctctggtaagcccatgccttcgaagtattcgtagctgccgccagagactttatggtacgggttttgcgcgtttttctgacgatcgaacgagaacactacgtcatcggcattcagttcgcgcgtcggtttgaattctttattgtcgtgccacttcacacctttacgcagatggaaggtataggttttaccgtcttcgctgacttcccacttttcagcgaggcccgggatcacttcagtggtgccgattttaaattcaaccagacggttataaagcggtacggaagaggcgtcataggtggtgccggaggtaaacagctgcgggttaaacccttccggagatccttctgagcaataaaccagagttttagcctgaacacttgctgcgacggtcatagccaccaggctgagaccaagcttcagcatccctgactttttcaaggaaatacgcattattctgctccaattgtgatgtttgttgttttaaccctttgcagtgggttgtcgctgcctgaccttttttgttttttgcccggtcgggtcaacgttatgaggtggggatgccgtactaattaacatcagtgtaacagtgcggatcctccataaaatgcccctcgtgacctacaatctgtcaacagaatgtgaaaacgtcaatacagccaaccgggatttacaccaacggtgagaatccacaaacaaagattaaaaaaacttcaaacagctatttgcagcagagaaatttgtgctacgccaacacaaccagaacaatcagcttaatatttagcaacatttggtgattaagttttatgcatttaatgaaaaaaatctgaggtaaaggtggatatctgagcgattaataccatgaacgctaaaacgcacagcggaaaatgccagcgccagccataagtaacgcaaaaaaagatttaagcaaatataaaaaaagacaatggtttctgtcacaaatccgttaatggatagtgagatatggggcgcaaatttggcagggaaatgtgtggtgtgtagatcggataaggcggtcgcgccgaatccgacaatgggccggtacatttgcctgatgcgacgctggcgcgtcttatcaggcctacgtcgagtcgaacctccccgcccccggaggttctcttcctcatgagttacagatgcaaaaaagcctgctcgttgagcaggcttttcgaatttggtcggtgatagaggattcgaacctccgaccccttcgtcccgaacgaagtgcgctaccaggctgcgccaatcaccgaatgcggggcgcatcttactgcgcagatacgccctcgtcaatcccttaatagcaaaatgccttttgatcggcgagaaagtcagcaggcctagttagccgacgcctcttttgcctgcgggatgtgacaccagttgttgttttcgttaattccaccatccggtgaagtatagccaagacaacccatgatggtgtcgtacagctctacatgacggcgtggcactttcatgtcggcttcttttttcagctgcgcaaatgcctgcgcattgaccggattttccagatatttatccgacatccagaccatcatcggcacacggaactgttccggcggtgccagttcacgcggcgtgccgtgcaggtgctcgcgttcattaattgactcaccgtggtcagctgcatagaacacaatcgctttcttatcgcgaacctgatcaatcacgctggaaataaagtgatccacataggtcaccgagttgtcgtatgagttgatcatctgcgctttggtacagccgctatcaacaccaatacattccggcttccactgcgcaaagctgcgcgggtaacgctgggtgtagttaaagtgtgagcctttggtatgcagaatgatcagatgtttaccatccgggttgcgccccagcgattgctgcatttcgtctaccagtaacatatcatctaccggtttgccacggttacgtggctccgcaccaatctgctcacgataagcaatgttgtccgccatcgtattgctgtagaaccacatttcgctttgcatagcgtagagatcagaactgaatcctaactgcttcaataccgcgaaaatgttctgttcttttaatgtgcgctgcggattatcttctgctccaccctgacgtacaaacatgcaacgcagtgagagtttggttgcagtatcacaggagtaaccacggaacgccgccagatttttctcctgagccagcttcggtgtggtattgcgttcatagccgaaaatgcccatatgatcccagcgcgtggtttcaccaataatgaaaacgacatatgtatcatcaacgttttgtggagcctggtacgtaaacttcttcgcagggttaaggagagaattgttatcggaagattcatcgacccgcgcccaggcataaagacctaatgccgaaagccagtttgatggcagataagagttcgcgacgacgccgccataactcggcaaatcaacacctgtcgccctctccactttcttctgctggatatccagcaaacgaatcggtgcccaaaccataatacctgccagtacgacgaccgccaggctgcgaatacgttgccctggggttcgcagttgtcggagcaaggtgtaacgacagcggttattccagataaggataagaggcaacgcgcttacggcgattaaccagagaataaagttcagaccaacaacttcttttgacaggtcgatatcggtggtcatgacggatgcgatgatgccataaccaatgactacattaaggaaggtcatgtaatagctggcacctgcggaaaagagcaccaccagcgatgccagaatacgccagctgcggcggccaaacagcgaaagaagacgcagtaaaaagaaggtcaccagtacggtggcggccagttcaacaacagcagaaatgcctttccagacggtaaaatcgtgcgcatagctgccgaaacggcggtaaaaaaccgcgccattcataaaaaggccaatatagattgcaagcaaaaagctcagcttctgctgtgtaatcgatttgatgtatctcatgcaaacaaaccctggacaaacaggtgataacaccctgcttagtggcttttcaggcctggcaggggaaaagtgcggaggtagtcagataagtaaaatctacacgcgcgaataagtagaccacagcaaagggaaaaagtgtggggaaagagtgtgcacgaagcacaaatttacaaaaatgcaagtttgaaaagagactttagcgttacaaaaagcagtaaaaagggccagctaactggcccaaattttatgcgttattgtttatacatttcgttgatgcgtttgatgcacactgaagctgaagcccagtagctcgcggcagatgattaaagggagccatgcgcctcacgcaacattttctgctctggctggcgaatggtcgtagaaagcgccagtgacagaatcagcagggcgaaaatcacgtagaaagtcacatagaatccgccaaacagtgaagcgataatcgaaccacaaatgctgccgataccgaaaccgaggtaaatgacgccgtagtttttcgccaggttattgaggccgaagaactcactaaccagcgacgggaacacagtaatcgtgccaccaaagttaaatgccacacaggcaatcgctgcaaagaacgtcactgcattcaatggtgcaaacagcagggccgccatccccaccagcgcaatcacctgaccaatggtgataacacggatacgggcgattttgtcagacagaatgcccagcaccagacgaccagaaaggttggcgatggaaataaccgtcacagcattggctgcggaaattgcatcaagatgcgccagactttgagcgatatctttcgctacaccaatcacatacagaccactcatgcacgcagtcaggaacataaccgctaacatccagtactgcggtttacgcatcgactctgccagggtgtagtccttctccaccacaccattgctggttttcacttcctgcttcggcgcatctttcattaacgttgcgccaaagacaatcatcaccagtacaatcgcgccccaaataacaaaggttttttccagacccaccgtttcgagcaggtgcgtgtcgataaatttaaaacccaggctgcccagaccataagaaccgatagcaaaagcagagataagtcccttacgctccggaaaccacttcacgcagttagagagcgtcaacaggtaacccgcgccatccgccagaccgaccagcacaccggcgcttaaccacagcatcatcaggttgttggaatgtgctgtcaggaagaaacctaatcccagcaaaatgccggaagccatagtgacgcgtttaacaccaaaacgttcctgcaatttgcccgcaacagaagacgaaattgccagccccagacttaacaagccgaaagagaaagcaacctggcttacaggagcccccagcttggcagaaagcgcaccgttaaacagactccaggtataaaccgaccccagagcaaactgggtaatgatagtaccgatgagtgtcagccagcgagtacgctgataatttgaaggtgtcatggcagtattcctgcagtaataaaaaggaaaaatctctgctgacaaccataacgaagtgcgctttatgcctggggaaaaacggcatgaaatgccatcagaacggaatgaaatgcattagttcaggaatgaatgactcgacaattattcgccaaatttattatttagtaagttagtccccactatcgccacattagttgttatttatgggtttcaattgtatctataacgttaaaatctggcgctaacccccatcgtatacagatagtcgctattgttagtggtattttctgcctgagatagcgcagcataggcagcaatattttgattgagcaacatatcagcgcctacggtgacatccagccagttgccgttctggtttgtcgccgtcatccggctcaggcctgattgcgccttccagatattctcgccaaattgctggttatagctgatttgcgcccagggtcggagatcgccaagccgggagtcaacacgccagcctaaggtactcacgctggcatgccataacggatcggccagcgtggtagtactgtcgccaaactcgttatacatcgaggtggttgtgccatcgtaatgaaatgccgcgaccgggccggttgtaacctgctcatataaaggaaaattccagcccatactcatactgctggtcacatccacaggggtttcttccgccagattgacttccagtcccagcgccctttggctactttgaatacgttgcgacaaaatatcgttgtaatcaggttgatgatcgctatcccaggtgtaacgctctgtggaatgtccgggttgcgtatcaacgatatattcttgttgccaggcgtaagctgtgttgagaaaaaaggcactgattaccacgctcgcaagcaggcttagctgccagcgaccaccgcttttttttatgatcattaacacgactccagggaagagccgaattcggcaatattattgtcattgtatgaaggatatcgggcatagtagccctgtattaaatattgactttttcaccgatgcgtcaagaaaagcggctgaaatttttacgatcgggtacatagcgagggaaagtatggaacgttgcggctgggtgagtcaggacccgctttatattgcctaccatgataatgaatggggcgtgcctgaaactgacagtaaaaaactgttcgaaatgatctgccttgaagggcagcaggctgggttatcgtggatcaccgtcctcaaaaaacgcgaaaactatcgcgcatgctttcatcagttcgatccggtgaaagttgccgcaatgcaggaagaggatatcgaaagactggtacaggacgccgggattatccgccatcgtgggaaaattcaggcaattattggtaatgcgcgggcgtacctgcaaatggaacagaacggcgaaccgtttgccgactttgtctggtcgtttgtcaatcatcaaccacaggtgacacaagccacaacgttgagcgaaatccccacatctacacccgcctccgacgccctatctaaggcactaaaaaaacgtggttttaagtttgtcggtaccacaatctgttactcctttatgcaggcatgtgggctggtgaatgatcatgtggttggctgctgttgccatccgggaaataaaccatgattcgggaagtgcaacgttcagaactccccgcgatcctccaactgtggctggaaagtacaacctgggggcatccctttataaaatcgagttactggcgtgactgcattccgctggtgcgggatgcgtatcttgccaacgcgcaaaactgggtctgggaagaagacggtaagcttctcggttttgtcagcattatggaaggccgattcctcgcagcaatgtttgtcgcaccgaaggccgtcagacgcggtattggtaaggcgctaatgcagtatgtgcagcagcgccatccccatctgatgctggaggtttatcaaaaaaatcaaccggcgatagatttctaccatgcgcagggttttcacattgtcgattgcgcatggcaggatgaaacccaactacccacctggattatgagctggccggtggttcaaacgctgtaagtgtcagttccgaaccggtgtatttttccagccatgccagcgccgtattacccgcacagccattccccagccgcgagctggggagatctttggtcagcacgttcactgcgccgtttttacaaatgccgccagcggttaaatccaaatccggccatgcgccttcgtgaatacaaatcacgccaggtttaattccctcgctaatgaccgcgccggcaagaatttgcccgcgtgagttccacagccgaacagtatcgccatcttgtatgccgcgcgtctgggcatcgtcaggatgaatggtgacaggctcacgatttgccaccgcgtacaattcgcgcagagaactgtaattcagctggctgtgcagacgatgcgccggatgagcagaaagtacctgcaactgttccggttcggcactgccctgccattcgtccggcgccagccacattggatgccccgggcaatccggataagcgtaatcggcaatacgctgcgagaagatttcaatcttaccgctggcggtttttaatggatgcgcctgcggatcgcggcgaaaatcggcgaagcgaataaaccgctcactgtccgggttttccggcatctcaattaactggttggcttgccagaactcagcaaatggcggcaattcaacctgctggcttgccccgcgctgccgggcaacgttataaaacgtttccagccattgcagctcactttttccttccgtaaaacgtgcataaccgcccttctgccaacgttcactcaagtcggcaaaaacatcaaaatcattacgcgcttcatagcgtggcggcaccacttgcttcatcggcaccagatgctgattactgtaatcaccggtcatggtgagatcattacgctcaaaagaggttgtcgcaggcagaacgatatccgcgtgtttcgccgcagccgtccagaagcattcggagatcaccaccagctccggtttttgccaggcacggatcaggcgattggtatcctgatgatgagtaaagttggcaccacccgcccaccagataaaacgaatatccgggaaatgtcggtccataccgttatgttgatatgcgccaccagggttttccagtgcttcaacaatgcgggcgacagggattttatctaccgcatcggtgccacccggcaagctgccctgcatggaagagagcaccgcagcgcggcgcgtggggttaccaccattggcaaaatggtaagaaagaccaaaaccgccgccgggtgtgccgatttgccccaacattgccgccagcgtgacgagcatccagtgtttttgctcaccaaactgttggcgctgcattccccagcctgccatcagcatggttgtattttggtggaaaatagccgccagctcgcggattttcgctgcgccaacaccacaaatctctgccgcccattcggcgtttttcgctataccgtcactctcgcccagcaaataagaggcgaagacggcataacctgtggtgcaacgcgccagaaacgcttcgtcgtgccaaccattttccaccagcgtatgggcgatccccagcatcaacgcaacatcggtgcccatgtgtggtgccacccactccattttatcgccaaagaaatcgatggtttccgatcgcattggatcaatgcagatcagctttttcccgctgtcacgcagtgcggaaaagtaagaaagcccctgctcatcggatgcattccacgcaattttcagcgtattgagtgggttagcactccacagcaccacgacatcgctatgttccagcaccagcggccaactggtttgctgttgataaacttcgctgccacccacgacatacggcatgatcgcctgtgccgcgccggtcgaataatcccccagatgcccggtataaccgcctgccaacgccatatagcgttgtaataatgtcgaggccttatgcagcacgccgtttgaacgccagccgtaggaaccagcaaaaatcgatgccggaccataagcctcacgaatgcgtttatgttgatggtgaataagctccagcgcctcatcccaactcacgcgaacaaattcatcctgcccacgaatgccttgcggattttccggtgacgcaagaaagcctttgcgcaccattggaaatcgcacccgcgtattgctgtgaacctggtcgcgaaccgcgctctgcaaggagttttccattcctgtggctaacgcgccacgcgagctaaacacggtttcgccgtcggtttcaaccagcataggcccccagtgggcggcagtcagaacggaatatcgtgaggatgagttggccaaaccgaagactcctgaaaggttagatgtattgagcagttaaatattacttacaaatttccgagtattcccaggaataatcttcatgctcacgcggcataatctcccgccacggaacccgtggcaaagaataaaaaggttattaaggattaacaatgaagaaacgtgtttatcttattgccgccgtagtgagtggcgctctggcggtatctggctgtacaactaacccttacaccggcgaacgcgaagcaggtaaatctgctatcggcgcaggtctgggctctctcgttggcgcgggtattggtgcgctctcttcttcgaagaaagatcgcggtaaaggcgcgctcattggcgcagcagcaggcgcagctctgggcggcggcgttggttattacatggatgtgcaggaagcgaagctgcgtgacaaaatgcgcggcactggtgttagcgtaacccgcagcggggataacattatcctcaatatgccgaacaatgtgaccttcgacagcagcagcgcaaccctgaaaccggcgggcgctaacaccctgaccggcgtggcaatggtactgaaagagtatccgaaaacggcggttaacgtgattggttataccgacagcacggggagtcacgacctgaacatgcgtctctcccagcagcgtgcggattccgttgccagcgcgttgatcacccagggcgtggacgccagccgcatccgtactcaaggccttggcccggctaacccaatcgccagcaacagcaccgcagaaggtaaagcgcaaaaccgccgtgtagaaattaccttaagcccactgtaatccctttcatgtcaggtgatgcagaaatcacctggcattcttcagttttccttcatcatatttcaggctaaggtgatcgccttatcagtgaatggagagaagcatgaagccgtccgttatcctctacaaagccttacctgatgatttactgcaacgcctgcaagaacatttcaccgttcaccaggtggcaaacctcagcccacaaaccgtcgaacaaaatgcagcaatttttgccgaagctgaaggcttgctgggttcaaatgagaatgttgatgccgcattgctggaaaaaatgccgaaactgcgtgccacatcaacgatctccgtcggctatgacaattttgatgtcgatgcgcttaccgcccgaaaaattctgctgatgcacacaccaaccgtattaacagaaaccgtcgccgatacgctgatggcgctggtgttgtctaccgctcgtcgggttgtggaggtagcagaacgggtaaaagcaggcgaatggaccgcgagcataggcccggactggtacggcactgacgttcaccataaaacactgggcattgtcgggatgggacggatcggtatggcgctggcacaacgtgcgcactttggtttcaacatgcccatcctctataacgcgcgccgccaccataaagaagcagaagaacgcttcaacgcccgctactgcgatttggatactctgttacaagagtcagatttcgtttgcctgatcctgccgttaacggatgagacgcatcatctgtttggcgcagaacaattcgccaaaatgaaatcctccgccattttcattaatgccggacgtggcccggtggttgatgaaaatgcactgattgctgcattgcagaaaggggaaattcacgccgccgggctggatgtcttcgaacaagagccactgtccgtagattcgccgttgctctcaatggccaacgtcgtcgcagtaccgcatattggatctgccacccatgagacgcgttatggcatggccgcctgtgccgtggataatttgattgatgcgttacaaggaaaggttgaaaagaactgtgtgaatccgcacgtcgcggactaagccgcgactgcgtggagtaaagcccgataatcgctcgggcttttactctttattgggttgcagtaacagctgtagtccaggcctgattaaacgcctgatgttgtgccggtaatggcgcaatcagtttgttatattcacttgcctgctgtgaagtcgggaactggatgccatttgcgacaaagctcacctgagtaccttgctgagcaatgtagtctccaaccatcaccagttgttgcgtgaaagtttgtgccgccggaatcaacggttgcaatgcatcagctggcgtcgttaccactttggtgaatgcctgatcaaagaccggtttcaggtcatcactctgttttaacgcagagtgcgcagcatcggcctgcaacttcgcattttgcagctgttgcgccagcacacccagcgaaccgttcatttcacgcagcggaccgctttgcgtaacgtaatcctgcggtacgcgaattgcgttaacgctgtctacaaccgggcgcagaccggaatccatcgcctgattcacctgctgagaataaccatacagaatcgcgtaatcagagacaaaaggaccaaactgttttttctgatcggcagtcagggttggtagacgttcaccgctacgcatcactgtattctgcaggaagtcgataaacgctttacgctgatcgccttctttatcaaaacacccactcaggctaactaccattaataacgccgcaagaggcgcaaaccagcgagagcaggactttcctgtcgccattttcttactcctttcacccaaaaaaagcgcacaacgacacacgcgtgtctgacgtgacaaggatagtccaggacaggcttgcaggataccctttctacgtaatcttcctggtaaaatcatggagaaaatgaaacaaggttaatttgttgtttcattgttaaaaaatgatattgccgttgccttttttgtagccagagatttacgccttcgcagaacgttagattttcgaaatctttacaaaccgggagtggtaagagatatatcggcatttatcagatcgttaggtggctataagtcacgctaaatgactggctgaatcgaatcatagtcagagtatgccctgactacaccccgctgtgtctgtttttcccgactattcttaatgagcttcgatgcaattcacgatcccgcagtgtgatttgaggagttttcaatggaatataaagatccaatgcatgagctgttgagcagcctggaacagattgtttttaaagatgaaacgcagaaaattaccctgacgcacagaacaacgtcctgtaccgaaattgagcagttacgaaaagggacaggattaaaaatcgatgattttgcccgggttttgggcgtatcagtcgccatggtaaaggaatgggaatccagacgcgtgaagccttcaagtgccgaactaaaattgatgcgtttgattcaagccaacccggcattaagtaagcagttgatggaatagacttttatccactttatttctgtttacggtcctgataacaggaccgttttccaaccgattaatcataaatatgaaaaataattgttgcatcacccaccaatgcgtggcttaatgcacatcaacggtttgacgtacagaccattaaagcagtgtagtaaggcaagtcccttcaagagttatcgttgatacccctcgtagtgcacattcctttaacgcttcaaaatctgtaaagcacgccatatcgccgaaaggcacaattaattattaaaggtaatacactatgtccggtaaaatgactggtatcgtaaaatggttcaacgctgacaaaggcttcggcttcatcactcctgacgatggctctaaagacgtgttcgtacacttctctgctatccagaacgatggttacaaatctctggacgaaggtcagaaagtgtccttcaccatcgaaagcggcgctaaaggcccggcagctggtaacgtaaccagcctgtaatctctgcttaaaagcacagaatctaagatccctgccatttggcggggatttttttatttgtttttcaggaaataaataatcgatcgcgtaatagaatctagtgttatttttgtgaagaataaatttgggtgcaatgagaatgcgcaacaccgtaagaaaggcgggaataatttcccgccgaagacgcttactctttcaatttgcaggctaaaaacgccgccagctcataactctcctgtttaatatgcaattcacacagtgaatctcttatcatccaggtgaaaaataaaagcgtgaaacaaatcactattaaagaaagtaatctatatttctgcggcattcccagccccctgtgttgatttccaacgagtaagaggctaaccttatggtgtctatgcatagaggggcctcactttgatttatagtcaggtggggcttttctctgtctgcctttcggtgaatacctgagacaaacagtctcaagcacccgcagctattccagcttaataagttcgtttcttctccttgatataatcctaaaaaaatctcataaaattaatatatgagataatctttattcagcagaagattattaaaggttgctgtattatttagcgataaaaaaagcctgccagatggcaggctttttaataacggcgttattactgcaacagcgaaatatccgcaacgcgcaggaacagttcgcgcagtttttccagcatggtcagacggttgatacgcaattctttatcatcaaccatgaccatcactttatcgaagaaagcatcgaccggttcacgcagctcagccagttcgaccagcgcatcctggtaacgaccttccgcaaagtacggctccagcttgtcacgtagcaccacaacctgcatagccagcttaatttcttccggctctttcagagtagaggcattcacgcgatcgctcagcacttcgtcagatttcgccagaatgttagatacacgtttgttcgccgccgccagtgctgcagctgcttccagggtacggaagtgcgataccgctttcatacgggcatcgaaatcagccggacgagtcggacgacgcgccagtaccgcctggatggtgtcaacggtgtaaccttcgtcctgataccaggcgcggaagcgaccgagcataaagtcgataacatcatcaaccacgttggcattagtcagcttatcgccatacagacgcaccgcttcttcggtcagcgtttgcagatcaaggttgaggttcttctcaacgataatacgcagcacgccaagtgcggcacgacgcaacgcaaacgggtctttgtcgcctttcggatgctgaccgataccgaatatacccgccagggtatccatcttgtcagcaatcgccagcgcacaggctaccgggttggacggcaggtcatcaccggcaaagcgcggctgatactgctcattcagcgccaccgcgacatcttccgcttcgccatcgtgacgcgcgtagtgcatccccataacgccctgggtgtcggtgaactcgaagaccatgttggtcatcaggtcacacttagacagcaggcccgcacgggtagcgtggttaacgtcagcgccaatctgttcggcgatccagccagccagcgcctggatgcggtcagttttgtcgcgcagcgtccccagctgttgctggaacagcacggtttgcaggcgcggcaggttatcttccagacgttttttacggtcggtattgaagaagaactcagcatccgccagacgtggacgaacgactttctcgttaccagagataatttgctgcggatctttcgattcgatgttggcaacgaagataaagttcggcagcagtttgccgtcgttcgcatacaccgggaagtacttctggtcacctttcatggtgtaaaccagcgcttcagacggcaccgcgaggaatttctcttcgaattttgcggtcagcacaaccggccattccaccagcgaagcgacttcttccaacaggctttcgcttaagtcagcgttaccgccaatcttacgcgccgcttcttcggcatcggctttaatcttcgctttacgttcttcgtaatcggcgatgactttaccgcgctcacgcagaatttccggatactgatcggcattatcgatggtgaattccggctcgcccataaagcggtggccgcgaatcacgcgatcggactgaatgcccagaatggttgccggaataactttgtcgcccagcagcagggtcacggtgtgcaccggacgcacgaagtgcacgtcgcttgcgccccaacgcatcagtttcgggatcggcagtttcgccagcgaagtcgcaaccatattcggcagcagtgcttcggtgctttcgcccttcacatgggcgcgatacagcagccattcgcctttgtcagtggtcagacgctcggcctggtcaacggtaataccgcagccacgcgcccagccttctgccgctttgctcggtttgccttcagcgtcgaacgcctgggcaattgccgggccgcgtttttcgatttcacgatccggttgcgcttccgccaggttagccactttcagcgccagacgacgtggagccgcaaaccattgaacggtgccgtgtgcgaggccagcgttatccagctccgcagtaaagttcgcagcaaaggactcagccaggctgcgtagtgcttttggtggcagctcttcagtgccgatttccaccagaaaagttttctcagacatagccgcctcttacttatctttgttgcacatcgggaagccgagggcttcacgggaagcgtagtatgcttctgccactgctttggtcagggtgcgaatgcgcagaatgtagcgctgacgctcggtgacggagatggctttacgcgcatccagcaggttgaagctgtgggcggctttcagaatacgctcgtaggctggcagcggcagcggattttccagcgccagcaactgctgcgcttctttctcgtactgctcgaagcaggtgaacaagaagtccacatccgcgtattcgaagttgtaagtggactgctccacttcgttctgatggaacacgtcgccgtaggtggttttacccagcgggccgtcgctccagaccaggtcgtaaacgctgtctacgccctgaatgtacatggccagacgttccagaccgtaggtgatctcaccggtaaccggtttacattccagaccaccaacctgctggaagtaagtgaactgcgtcacttccatgccgtttagccacacttcccagcccagcccccaggcacccagcgtcgggttttcccagttatcttccacgaaacggatgtcgtggatggtcgggtccatgcccagctctttcagagaaccgaggtacagctcctgaatattgtccggcgatggcttaatgaccacctggaactgatagtagtgctgtaaacggttggggttttcgccgtagcgaccatcggtcgggcgacgagaaggctgaacataagcagccgccatcggttctggccccagcgcgcgcagacaggtcattgggtgagaggttcccgcgccgacttccatgtccaatggttgaacaatggtgcagccctggcgagcccagtaatcctgtaaggtcaggatcaagccctggaaggtcctggtatcaaacttttgcatattatttcgtgctggatacgtgtggatttaaaggaagggatcagtatacccgctggatggaagatatacagtacgaaacgggaaaaagcagggcttaacgcatggaaagatgcaaaaaatggccatccgcgtcaaaagaacagacaaactgctctttccggaaggtataaccgcgcatttcatagcttccctggaactgttcgaaggcggtgacgtcgattttttgctcgccggtgttataacgttttgccgcctgatccttgcataacgcttccatattcaacgaacgcagaggatcaacctttacccgttgtgctttctgcacgggtggcggtgtagaacaacccactagcacaataagcgccattgctggaaagaaagcgttcatcatcattaaattaccgtctggtttgcaggtgagtcttattatttatatcggtatagtggctgatatcttacgaatttccttaagcctctataagctgtagtgataaaactcagattattccagtgcgccaactgaatgatttatcggtcagactttttttaaccagatacagagacacagatgcagcccaaaatttactggattgataacctgcgagggatagcgtgtttaatggtggtgatgattcacaccactacctggtatgtgaccaatgctcatagtgttagccccatcacctgggatatcgccaatgttctgaattctgcctctcgtgtcagtgtgccgctatttttcatgatttccggctatctcttttttggcgaacgcagcgcccagtcgcgtcatttcttgcgtatcggcttatgcctgtttttttatagcgcaatcgcgctgctctacattgcgctgtttacctccatcaatgtggagttagcgctgaaaaacctgctgcaaaagccagtgttttaccatttatggtttttcttcgcgattgcagtgatttatctggtttcaccgctgattcaggtgaagaacgtcggcggaaaaatgttgctggtgctaatggtggtgattggtatcatcgctaacccaaacaccgtgccgcagaaaatcgacggttttgaatggctgccaattaacttatatatcaatggcgatactttttactacatcctttatggcatgttgggccgcgctatagggatgatggacacacagcataaagcactgtcgtgggtgagcgccgcactgtttgcgacgggggtttttattatctctcgcgggacattatatgaattacagtggcgcggaaattttgccgatacctggtatctttactgtgggccgatggtttttatctgcgcaatcgcgttattgactctggttaaaaacacgctgtatacgcgtaccatttgcggacttggcttaatctcccgccattcgttaggtatatacgggttccatgcattgattatccatgcactgcgcacccgggggattgagcttaaaaactggccaatactggatattatttggatcttttgtgcgactctggcagtgagtttattactttctatgctggtacaacgaatcgacagaaacagattagtgagttaagtagaagcccggtcacattggactgaccgggcttacgtgaattattcgctgtattcttcctgggtaacctgtgtttcttttggtgggtttattccggcatcatgaatattcttctgcaccgctactgcaccaaacaagcttaagaagaaagccagcccataaaagcctttttcgctgagtaataacgttgcattccatagacctaccagcaacaacgcaacagagataataaagaccgtaaggcaagtcatataataaatgggggtggtaggtatgccttcatacttgtcccgaacggtcttttgataagacgccgcggaaaacaaacctaataccagtacggcaaaataataccctttttcatttaactgcatctctgcattccatagtcctaacagataggtaacaataccgccaataagggctacccatgaaacaatactaaatgccggagaataggttgatattttgttgtccatcacagtattcctttcattcctgaatgtgtaagaactttatgttgctcatgccgagcgaaacaaacgcatttgaccaaacaagcagacaaaaaaggcgatgggatagatcaccatttcataagcattgataggtgcgtttaaaacaccgataaacaagagaccgatagtgattaacgctaccaactgacagacgtggataaaaaaatcatccagttgcccaagtttttctgcgcgaagatatgcatagttgccaaaagttgccgtcattaacacgccaagaaaatagccttttccacttaacaatgggcatgagatccatagcccaaccagataaaccagcgccccaacaacaaataatagttttgcaacagtctttgaggttttcataacgatctccatatctaccagcgatacattacgaataaccaacgaaagacaaaactgaaaaatgccattaacaaatgattttcagaataaattcatactaaatattaattaattactgagatatatagatgtgaattatcccccacccggtcaggcaggggataacgtttacgccattaatggcagaagttgctgatagaggcgacggaacgtttctcgtcgtggctgataagcggcataacgctgcgcatctggtagatgcgactgttctaatggtagttgcggcaacaactcaatgagcgatttctctggattcgccgcaatctgcgccagccttgctgcgcccagtgctggccccacatcgccacccgtgcggtaatccagttgctgaccgctgatgtccgccagcatttgacgccagtactcactacgcgccccgccaccaatcaacgtaacactttgcggtttaatgccgcaggcatgcacgacatccatgccatctgccagcgcataacccacgccttccagcactgctcgcgccagttcattggggccatgttgatgagtcaaaccaaagaacccccctttcgcctggggattattgtgtggtgtacgctcgccggaaagataaggcagaaaccaaactggctcggcactttcatcagcctgttgagctgcagtgattaaagcagggacattgctcaggccggttaatttcgcggcccaatccagacacgaagccgcactcagcattacagacattaaatgccaacgttgcggtaacgcatggcaaaagctatgtacggcgctttctggcttgcttaagaacccttcgctgacagcaaaatagacccccgacgtccccagcgataacattgcctgattagcatcaaccattcccacaccaaccgcaccagctgcattgtcgccaccgcctgcgataactggcaccgccgccataccccacgctttcgcaacttcaggtaacaaagcaccagtaatttcgctgccttcgtataatgcgggcatctggtcacgagataagtggcaagcctgcagcatgagatcgctccagtcacgctttgcgacatccagccacatagtgccagctgcgtcagacatatcgctggcaaactcccccgtcatacgcagacgcaagtaatctttcggtaataatactttatcgatttgacggaatatctccggctcatgccgctgaacccatagcaatttaggcgcagtaaatccgggcatcatcaggttgccggtaatcacccgcgattgcggaactcgcgcttccagcaaagtgcactcttgcgcacagcgcccgtcgttccacaaaatggcagggcgtaacacccgttgctgagcatccagtaaggttgcaccgtgcatctgtccggcaatacctaatgctttaacgtcttgcagagaatgctgaacgcccagagctttcattgcgcgatcagttgcctgccaccactgttccgggtcttgttccgaccagagtggatgcgggcgcgaaacggtcagcttttccgtttgcgcagcaaccacctcaccctgctcgttgagcaaaataacttttacgcccgaggtgccaagatctatcccgatatacatatcgatcgttccttaaaaaaatgcccggtatcgctactgataaccgggccaacggactgcacagttagccgttatttgtcgaacagataatgatttaccagattttccagttgctcctggcgaccactctgatgcaccggagacaaattatgttcctgagcatatttggctaaatctgccagtgacatttggcctttcaggatttgctggcctaattcactattccagccggaataacgctgcgcgatgcgtttatccagctcgccatcttcaatcatgcgcgctgcaattttcagcgccaacgccatcgtatccatcgcgccgatatgaccgtaaaacagatcatatttatcagtactttgacgacgtactttggcatcgaagttcagaccaccggtggtgaaaccgcctgctttgagaatttcatacatcaccagcgcattctcttccacactgttcgggaactggtcggtgtcccagcccagttgcgcatcgccacggttggcgtcgacagaaccgaacaggccaagcgcaatggcggtggctatttcatgatggaaagagtgacctgccagcgtcgcgtggttagcttcaatgttcagtttaatctctttttccagaccaaactgtttcaggaagccatagaccgtcgcagcatcgtaatcatattgatgttttgtcggttcttgcggtttcggttcgataagcaacgtgccctggaaaccgattttatgtttatgctcaaccaccatctgcataaagcggcccagctgttcacgctcctggcgcaagtcggtatttaacagcgtttcgtaaccttcacgaccgccccacaggacatagttttcaccgcccaatttatgggttgcttccatcgctgtaacaacttgcgttgccgcccaactgaagacttcaggatctgggttcgtcgccgcacccgcgccatagcgagggtttgtaaagcagttagcagttccccacagcagcttcacgccgctctcttcttgcttgcctgccaggacatcaaccatttgcgcaaaattattgatgtactcttttaacgacgcgccctcaggggaaacatccacatcgtggaagcaataaaatggcacatgtaacttgtggaaaaactcaaatgcgacatctgctttacgcttcgccaacgccagtgcctcaccaggctgctgccacggacgattaaacgcccccacaccaaacatatccgccccgttccagcagaaggtgtgccagtagcaggcggcaaaacgcaagtgctcttccatacgcttgcccaacaccagttcgtcgggattgtagtgacggaatgctaacgggtttgaggattttgagccttcataacgaacgcgatcgagctggtcaaaataggcttgcatattgaactccataatcaggtaatgccgcgtgtgatggatgatgtcgtaatattgggcactccctttcagttgctcaattatgttatttcacactgctattgagataattcacaagtgtgcgctcgctcgcaaaataaaatgggatgatgaaactgggtaattcctcgaagagaaaaatgcaataagtacaattgcgcaacaaaagtaagatctcggtcataaatcaagaaataaaccaaaaatcgtaatcgaaagataaaaatctgtaattgttttcccctgtttagttgctaaaaattggttacgtttatcgcggtgattgttacttattaaagctgtcctctaactacagaaggccctacaccatgaaaataaagaacattctactcaccctttgcacctcacttctgcttaccaacgttgcggcacacgccaaagaagtcaaaataggtatggcgattgatgatctccgtcttgaacgctggcaaaaagatcgagatatttttgtgaaaaaagcagaatctctcggcgcgaaagtatttgtacagtctgcaaatggcaatgaagaaacacaaatgtcgcagattgaaaacatgattaaccggggtgtcgatgttcttgtcattattccttataacggtcaggtattaagtaacgttgtaaaagaagccaaacaagaaggtattaaagtattagcttacgaccgtatgattaacgatgcggatatcgatttttatatttctttcgataatgaaaaagtcggtgaactgcaggcaaaagccctggtcgatattgttccgcaaggtaattacttcctgatgggcggctcgccggtagataacaacgccaagctgttccgcgccgggcaaatgaaagtattaaaaccttatgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggaggggcaattcaggcattaagcgcgcaaggtttatcagggaaagtagcaatttccggccaggatgcggatcttgcaggtattaaacgtattgctgccggtacgcaaactatgacggtgtataaacctattacattgttggcaaatactgccgcagaaattgccgttgagttgggcaatggtcaggagccaaaagcggataccacactgaataatggcctgaaagatgttccctcccgcctgctgacaccgatcgatgtgaataaaaacaacatcaaagatacggtagttaaagacggattccacaaagagagcgagctgtaagcgttacgccccggcgcggagcgggggcgtgatttctctccatgccgcgtgaattgattggcttaggtggagtcgttatgccttatctacttgaaatgaaaaatattaccaaaaccttcggcagtgtgaaggcgattgataacgtcagcttgcggttgaatgctggcgaaatcgtctcactctgtggggaaaatgggtcaggtaaatcaacgctgatgaaagtgctgtgtggtatttatccccatggttcctacgaaggcgaaattatttttgcgggagaagagattcaggcgagtcacatccgcgataccgaacgcaaaggtatcgccattattcaccaggaattggcgctggtgaaagaactgaccgtgctggaaaatatcttcctgggtaacgaaataacccataatggcattatggattatgacctgatgacgctacgctgtcagaagctgctcgcacaggtcagtttatccatttcacctgatacccgcgttggcgatttaggacttgggcaacaacaactggttgaaattgccaaggcacttaataaacaggtgcgtttgttaattctcgatgagccgacagcctcattaactgagcaggaaacgtcggttttactggatattattcgcgatctacaacagcacggtatcgcctgtatttatatttcgcacaaactcaacgaagtcaaagcgatttccgatacgatttgcgttattcgcgacggtcagcacattggcacgcgtgatgctgctggaatgagtgaagacgatattatcaccatgatggtcgggcgggagttaaccgcgctttaccctaatgaaccacataccaccggagatgaaatattacgtattgaacatctgacggcatggcatccggttaatcgtcatattaaacgagttaatgatgtctcgttttccctgaaacgtggcgaaatactgggtattgccggactcgttggtgccggacgtaccgagaccattcagtgcctgtttggcgtgtggcccggacaatgggaaggaaaaatttatattgatggcaaacaggtagatattcgtaattgtcagcaagccatcgcccaggggattgcgatggtacccgaagacagaaagcgcgacggcatcgttccggtaatggcggttggtaaaaatattaccctcgccgcactcaataaatttaccggcggtattagccagcttgatgacgcggcagagcaaaaatgtattctggaatcaatccagcaactcaaagttaaaacgtcgtcctccgaccttgctattggacgtttgagcggcggcaatcaacaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctgaagtgaaattagccgtaccgacatccggtggcttttccgggctgaaatcactgaatttgcaggtcttcgtgatgattgcagcgatcatcgcgatcatgctgttctttacctggaccaccgatggtgcctacttaagcgcccgtaacgtctccaacctgttacgccaaaccgcgattaccggtatcctcgcggtaggaatggtgttcgtcataatttctgctgaaatcgacctttccgtcggctcaatgatggggctgttaggtggcgtcgcggcgatttgtgacgtctggttaggctggcctttgccactgaccatcattgtgacgttggttctgggactgcttctcggtgcctggaacggatggtgggtcgcgtaccgtaaagtcccttcatttattgtcaccctcgcgggcatgttggcatttcgtggcatactcattggcatcaccaacggcacgactgtatcccccaccagcgccgcgatgtcacaaattgggcaaagctatctacctgccagcaccggcttcatcattggcgcgcttggcttaatggcttttgttggctggcaatggcgcggaagaatgcgccgtcaggctttgggtttgcagtctccggcctctaccgcagtagtcggtcgccaggctttaaccgctatcatcgtattaggcgcaatctggctgttgaatgattaccgtggtgttcccactcctgttctgctgctgacgttgctgttactcggcggaatgtttatggcaacgcggacggcatttggacgacgcatttatgccatcggcggcaatctggaagcggcacgtctctccgggattaacgttgaacgcaccaaacttgccgtgttcgctattaacggattaatggtagccatcgccggattaatcctcagttctcgactcggcgctggttcaccttctgcgggaaatatcgccgaactggacgcaattgcagcatgtgtgattggcggcaccagtctggcaggcggcgtcgggagcgtggctggagcggtaatgggggcattcatcatggcttcactggataacggcatgagtatgatggatgtaccgaccttctggcagtatatcgttaaaggtgcgattctgttgctggctgtatggatggattccgcaaccaaacgccgttcttgattttgataaaaattttctcaaagccggtaacgtattaccggttttgagtttttgcatgattcagcaggaaaagaaccatgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacaaatcgagcaagcgctggctgatgtcgacgtccccattgttggggttggtggctcgtatcaccttgccgaaagttacccacccgttcattacattgccaccgataactatgcgctggttgaaagcgcatttttgcatttaaaagagaaaggcgttaaccgctttgctttttatggtcttccggaatcaagcggtaaacgttgggccactgaacgcgaatatgcatttcgtcagcttgtcgccgaagaaaagtatcgcggagtggtttatcaggggttagaaaccgcgccagagaactggcaacacgcgcaaaatcggctggcagactggctacaaacgctgccaccgcaaaccgggattattgccgttactgacgcccgggcgcggcatattctgcaagtatgtgaacatctacatattcccgtaccggaaaaattatgcgtgattggcatcgataacgaagaactgacccgctatctgtcgcgtgtcgccctttcttcggtcgctcagggcgcgcggcaaatgggctatcaggcggcaaaactgttgcatcgtttattggataaagaagagatgccgttgcaacggattttggtcccgccagtccgcgtgattgaacgacgctcaacagattaccgctcgctgaccgatcccgccgttattcaggccatgcattacattcgtaatcacgcctgtaaagggattaaagtggatcaggtactggatgcggtgggcatatcacgctccaatcttgagaagcgttttaaagaagaggtgggcgaaaccattcacgccatgattcatgccgaaaagctggagaaagcgcgcagcctgctgatttctactaccttgtcaattaacgagatatcgcaaatgtgcggttatccatcgctgcaatatttctactctgtttttaaaaaagcatatgacacaacgccaaaagagtatcgcgatgtaaatagcgaggtcatgttgtagcgatgatgagaattatcggcgtcgcatcaggtaactcagcacaaccacctgatacgagcaaaagccttatccgcctgacaagtcggataaggctcgaggaaatgcaattacatatgcgccgcgattaaccgttggttatcctggtacattgcgaacaggtagttgttataactcttccctttggtcgagtagcccttcagcttgtgaatcatcgctgtggcagtcacttcctgatccgctttacgcagctgtgcacgcgatttacggaacgaagagtaagccgggtgcgtattgaggttagtgacataggcgctcaccgattctttaacagaactaaactgtgagtaccctttcactttacccggcgcattggtacaacgtcctttcatgcatttcatgccgaacagattgttgttgttgcgcgccagctttgacgttccccaaccgctttctgctgcagccatcgtcgccaccatactggtagggataatgtctacgcgttcaagcaaggtattccacgggatttttcgcgtattaccagaccacttcaccttgtagcgtttggcgatgtctttcagacgcgcacgctcagcaggtgaccattggccctgatactgttttgaaatcagccagttacgttccgcagtaatggccgcattttggctggtaatgtaaggcattacagtccggagaaacgcctttttccttggtgttccggaagggtattttcgcaaatcaggaagtgaactactctttgcactattgcgagaatactcttgtttactgcttacctgtttattactagctttagttaagtgggacttttgactcgctgttgttgtgtgcgtcttcgctaacacctcactcgaaaacaccagagtgagtaacataagaatcatcgccccatatcgtcgtatgggagtcaaaatcatcaggtctcctggtcggatttaatcattccaacaccttatattttttacaaatttgagagttgaatctcaaatcatatcaaaaatagctgtcaagagcaccccaaggaatagtccaaatctgaaactatgtcacgagttaacgattcagattggcgctaaatcgcagaaaatgtggggtttatcgcaaaattcagccgttttttgcgcgcgatcgctcacccttgcttctcatcctgtggacttaccgctcagggatgagttttgtctggcttatcgctggcaaactgtctgaaatcgcagcaataaggactcatccgccatgaaactcgccgcctgttttctgacactccttcctggcttcgccgttgccgccagctggacttctccggggtttcccgcctttagcgaacaggggacgggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccacctcaatggcgattgttcagggacggcgaatatacgctgcaactagacacccgctccggtacgccaacattgatgatttccctccagaacaccgtcgaaccggtagcaagcctggtccgtgaatgcccgaaatgggatggattaccgctcacactggatgtcagcgccacttttgcggagggagccgccgtccgggattattacagccagcaaattgcgatagtgaagaacggtcaaataacgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattatctccagcagttgggcgttaatgctttatggataagcgccccatttgagcaaattcacggctgggtcggcggcggtacaaaaggtgatttcccgcattatgcctatcatggttattacactcaggactggacgaatcttgatgccaatatgggcagtgaagccgatctacggacgctggttgatagcgcgcatcagcgcggtattcgtattctctttgatatcgtgatgaaccacactggctatgccacgctggcggatatgcaggagtatcagtttggcgcgttatatctttctggtgacgagctgaaaaaaacgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctggcctttttgccggatatcaaaaccgaatcaactaccgcttctggtctgccagtgttctataaaaacaaaacggatacccacgctaaagtcatcgacggctttacccctcgcgattacttaacccactggttaagtcagtgggtccgcgactatgggattgatggttttcgggtcgataccgccaaacatgttgagttgcccgcctggcagcaactgaaaaccgaagccagcgctgcacttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgattgtctggcgcagatggatacgacctggcagcaaatggcggagaaattgcaggatttcaacgtgttgagctacctctcgtcgcatgatacccgcctgttccgtgaagggggcgacaaagcagcagagttattattattagcgccaggcgcggtacaaatcttttatggcgatgaatcctcgcgtccgttcggtcctaccggttctgatccgctgcaaggtacgcgttcggatatgaactggcaggatgttagcggtaaatctgccgccagcgtcgcgcactggcagaaaatcagccagttccgcgcccgccatcccgcaattggcgcgggcaaacaaacgacactttcgctgaagcagggctacggctttgttcgtgagcatggcgacgataaagtgctggtcatctgggctgggcaacagtgatttttccggcttcccgttcgtcagtacctcgggaagctgccaaccaggataaaatgtcagccctaatcagcattgcaggataaagcaccgctcactcttcaacagaccgatttgcaccccagcaaatgtagcgttattgttaccttccttgctacagagttcgacagatatcccgctatgacattctccctttttggtgacaaatttacccgccactccggcattacgctgctgatggaagatctgaacgacggtttacgcacgcctggcgcgattatgctcggcggcggtaatccggcgcagatccctgaaatgcaggactacttccagacgctactgaccgacatgctggaaagtggcaaagcgactgatgcactgtgcaattatgacggtccacaggggaaaacggagctactcacactgcttgccggaatgctgcgcgagaagttgggttgggatatcgaaccacagaatattgcactaacaaacggcagccagagcgcgtttttctacttatttaatctgtttgccggacgccgtgccgatggtcgggtcaaaaaagtgctgttcccgctggcaccggaatacattggctacgctgacgccggactggaagaagatctgtttgtctctgcgcgtccgaatattgaactgctgccggaaggccagtttaaataccacgtcgattttgagcatctacatattggcgaagaaaccgggatgatttgcgtctcccggccgacgaatccaacaggcaatgtgattactgacgaagagttgctgaagcttgacgcgctggcgaatcaacacggtattccgctggtgattgataacgcttatggcgtcccgttcccgggtatcatcttcagcgaagcgcgcccgctatggaatccgaatatcgtgctgtgcatgagtctttccaagctggggctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgctatcattcgccgctatttaccggaagatcgctgcctgattcataaaccggaaggagccattttcctctggctatggtttaaggatttgcccattacgaccgagcagctctaccagcgcctgaaagcacgcggcgtgctgatggtgccggggcacaacttcttcccgggactggataaaccgtggccgcatacgcatcaatgtatgcgcatgaactacgtaccagagccggagaaaattgaggcgggtgtgaagattctggcggaagagatagaaagagcctgggctgaaagccactaaaaattgcctgatgcgctacgcttatcaggcctacatgatttctgcaatatattgaatttggtagaatttgtaggccggataaggcgttttagccgcatccggcataaacaaagcgcactatccctgcgttgagaaacgccggaaaaacgtttcaaacaggctgctgccgtagccgatgccgctgcactttctcgacatccacgcactgcaacgcctttgtcgggcaggcttcaacacaggccggccccgtcgcccgatgccagcacagatcgcacttaatcgccctcgcctttttgcgcgaagaaacgacctccatcgcaccaaacgggcaagccagcatacagcttttacagccaatgcaacgtgattgttcaacgaaaatatgcccatgttcgcggcttatcgcgtcaacagggcacacatttgcgcacggtgcatcttcacactgatgacaggctactgccgtggtgtaagtatgatctttaatgacacgaatacgggaaataaactcgtctggtgacaacgcagcgcaatcctgattctcctgatgcgacactgcgcaagccacttcacaggtacggcaaccgatacatttcgtcgcatccgcaataataaaccggttcatgatcactcctttgcactaaaacagcagagtgccagagagcgcgtccctactgctttgatccaacgaaggaaatgttaaagttttggcacttgtccaaagggttatgtaatcgcgccctggtcgtccctgacagtaaatcccagttcattagaaatagcctgcgcggtttcacgcagtggtttcaggagatttttctctcccacctgtttcagacgtgatgtcgaaagcgaaatcgacacggcgtacggcacccgcccatgaatatcaaacaccggaacagcaatacaggagacgccgagttcgttttcttctctgtccatcgccgctccactttcacgaatgtgcgccagttcgtcgaacatcgcgggcagctcggtaatggtattgcgggttaacggctggatctcatgctgatggctttcccagtatgacttcacgtagtccgggtgaccaaacgccatgtagatcttgcccattgcggaacagtagagcggcatatgctggcctatataggcacgggttcgcagcatcccggttgtgggttccaacttataaatcaaaatagcgtgatcgtcttcgcggctggagaagttaatagtttcaccagtggcgatgttcagagcctcaagatgcggagcggcgatatgaatgatattcagcgaagatagcgccttctgcccgacggcaataaatttggtggtcaggcgataactccctgcggcgggcgcggtggtcacatagccgcaggactgtaatccctgcaataagcgatggacggtactcttatttaaaccagccagctccgaaagatgcgccaacggacaaccgtttggatagttgctcaaaatctcaatcagcatcaacccacgaaacagactctggcttccggctgggcgctctttttcctgcgccatctcgttctctttttttcccatcacttctttccccattttgtcgcgtcctgatggtagcgcaaagtgtgccgtagttcacgatctcgacagataatttataaccacttgatttttaagttttttgaaattcatcaatcagattgctttgttaaaaagtgatcgatatatttgaaataaagtttcgcatattgaaattttaagccaaaaaagcgatcaaaaaaacaaggaagcctgggatgaaagtgacatttgagcagttaaaagcagcctttaatcgggtcttaatttcacgcggcgttgacaacgaaacggctgacgcctgtgcagagatgttcgcccgcaccaccgaatccggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccaccgtggggcgcaaaagagtgtcgcatcggcaccaacccgctgatcgtcgccattccttccacgccgatcaccatggtcgatatgtcgatgtcgatgttctcttacggcatgttagaagttaatcgcctggctggtcgtcagctcccggtagatggtggctttgatgatgagggcaatttgaccaaagaacctggcgttatcgagaaaaatcgccgcattttgccgatgggctactggaaaggttcgggcatgtcgattgtgctggatatgatcgctaccctcctttctgacggcgcatcggttgccgaagtcaccgaggacaacagcgacgaatacggcatttcacaaatttttattgccattgaagtggacaagcttatcgacggtcccacccgcgatgccaaactgcaacgcattatggattacgttaccagtgccgagcgtgctgacgaaaaccaggctattcgtttacccggccacgaatttactaccctgctggcagaaaaccgccgtaacggtattaccgttgatgacagcgtgtgggcaaaaatccaggcgttataaggagataagccatgatttttggacatatcgcgcagcctaatccgtgccgtttgcccgccgccattgaaaaggcgctcgattttctgcgcaccaccgacttcaacgccctggaaccgggcgttgtcgaaatcgacggcaagaatatttatgcgcaaattatcgatttaaccacacgcgaggcggtagaaaaccgtccggaagtgcatcgtcggtatatcgatattcagtttctggcgtggggtgaagagaaaatcggcattgccattgatacgggaaacaataaagtcagcgaatcactattagagcagcgcgatattattttttatcacgatagtgaacatgaatcatttatagaaatgataccgggtagttacgctattttcttcccgcaggatgtacatcgcccggcatgtaataaaaatgccactacggcaatacgcaagatcgtggttaaagtggccctcgctgctttataaaaaatgattactggagcacataatgaaaacgaataatgccggttatattatcggcgcgtatccctgtgcaccttcttttcaccaaagaagtgaagaggaagagaaggatttctggcgacaattatctgagactccagacattttggggctggaacaaccttgcctggaaaattttcacccgctgggcgatcaatggttactccgtcatacgccagagagctggaaatttgtcgtcaccgcagtgatggaaaccatgcgtcgccgcagcgaaaacagcgggtttggtctcgcctccagtgatgaagaacagcgccaggcctgcgtggcgtactatcgccacctgttcaataaaatcaactcattgcaggctaataaagtgctcgcactggagctccaggctgcaccgttagcaacgaatcctaatgttatgcaagcgacggacgcttttgcccgctcattgaaagaaatcgccagttgggactggccgtgcaagctggtgctggaacactgcgacgccatgacatcttcttccccccgaaaaggctttttgcctttagaaaatgtgctggaagttattaccgattatgacatcagcatctgtatcaactgggcgcgctctgccattgaagggcgcaatacaacgctgccgctgacccacacccaaatggcgaaacaagccggaaaactcggcgcgttaatgttctctggtacgacgctaaacggggcatacggcgaatggcaggatttacacgcaccgtttgcaccattctgcgcagaaagcctgatgaccacagatcatgttcgcgagttatttaatgtagcagaatcgtcaacattgcattttgctgggatcaagctactggaaataaatgcgacggctgatgtgcaccatcgcatcgaaatattacgcaacggcattcactctctgaatgaatctcgttaaacagaaccatttatatatcactttgaatatctaattagccgttttctgataattattacgaatattaacaacattagcgcataaaaaatattgcataaccagaaggactcgttatgaaacggatactcgaaggcattcttgcgatcatcatcgcaatactgtcttgtattatttttattaatatcattcttcgatatggattccacacaagtatattatcgattgatgaattatcccgacttttatttgtctggttaacctttattggcgcaatcgttgcttatatggacaacagccatgtgcaggttacttttttagtcgaaaaactctcaccggctaatcaacaacgtgtttcgctgctaacccatacgctcattttattgctgtgtctggggctggcctggggcgctatagaaaaaacagcgcaagactggagcaacttatcgcccattcttggcgtccccattggcttaatgtacgccgccgctatccccaccagtctgattatcgcattgctggaattgcgtcacttataccggcagttcacaaatacccccagccgaaaccaacaaggagcctgacgatgacaatccttatatttattgtcagtttgttaggggctatcgcaattggcgttcccatcgcctgggcattattactgtgcggcatttcattgatgttctggatggatatctttgatgtgcaaattctggcacaaacgttggtaaatggcgcagacagcttctccctgttagccatccccttctttgtactggcgggtgagatcatgaacgcgggcggcctgtcgcaacgtatcgtcgacttgccaatgaaactggtaggccacaggccaggcggtctgggttacgtgggcgtgctggcagcgatgatcatggcaagcctgtccggttctgcggttgctgataccgcagctgtcgcggcgctgctggtgccgatgatgcgccaggccaactatccggtaaaccgcgccgccgggcttatcggttccggggggattattgcggccattatcccgccttccataccactcattatcttcggcgtctccagcggactctccatcagcaaactgtttatggcgggcattgcgccaggcatcatgatgggcgtcacgctgatggttacctggtggtggcaggcaaaacgactgaatttaccttgtcagccgaaagcctcactgcgagaagtctggcaatccttagtttccggtatttgggcgctctttttaccgataattattattggcggtttccgttcggggttatttacaccgaccgaagcaggcgcggttgccgccttctacgctctgttcgtctcggtggtggtctatcgcgagatgaccttctccacgctttatcatgtgctgattaacgcggcaaaaaccacatccgtggtgatgttcctggtggcctctgctgcggtatctgcatggcttattacgatcgccgaattacccatgatggtatcggagctattacaaccgttggttgattcgcctcgcttattattcatcgtcattatgctcgctattatggtgatcagtacggtcatggacttaacgcctaccgtattaattcttacaccagtattaatgccattagtgaaagaagcgggaatagatccggtctatttcggcatcatgtttattatcaactgttcaatatcactgattacgcctccagtcggtaatgttcttaacgtggtatgcggcgtggcgaaacttaaatttgacgatgcggtaaaaggcgttgcgccttacgtcatggttttattcatgttgttagcattatttatttttataccggagctcattaccgctcctcttaaatggatgagttaaaaggaaatcataatgaaattacgttctgtaacctacgctttattaattgccggagtggcgacgttcagcacatcttctctggcggcacaatcattacgtttcggttatgaaacctcacaaaccgattcacaacatattgcggcgaaaaaatttaatgaattactgcaggaaaaaaccaaaggcgaactgaaattaaaactgttcccggatagcacccttggtaatgcgcaggcgatgatcagcggcgtgcgtggcggcactattgatatggagatgtctggctctaacaactttacgggactctcgcccgtcatcaacctgctcgatgtcccgttcctgttccgcgataccgctcacgcgcataaaacgctcgacggcaaagtcggtgatgacctgaaagtctcccttgaaggtaaggggctgaaagtactggcctactgggaaaacggctggcgcgatgtcaccaactcgcgtgcaccggtcaaaacgcctgccgacctgaaaggattgaaaatccgcaccaacaacagcccgatgaatatcgctgcatttaaagtttttggcgctaacccgatcccgatgccgtttgccgaagtctataccgggctggaaacccgcactatcgacgctcaggaacacccgatcaacgtcgtctggtcagcaaaattttatgaagtgcagaagtacctttctctgacccatcacgcctattcgccgcttctggtggtgatcaacaaagcgaagtttgatggcttaaccccggagttccagcaagcactgatctcatctgcacaggaagcgggtagctatcagcgcaaactggtcgccgaagatcagcaaaaaatcatcgacggtatgaaagaagcgggcgtggaagtcatcaccgatctcgaccgcaaagcctttagcgatgcgctgggtacccaggtccgtgacatgtttgttaaagatgttccgcagggtgctgatctgctgaaagccgtggatgaggtgcaataaaccatgacgcaatactggctggggttagattgtggcggtagctggctgaaagccgggctgtatgaccgagaaggccgggaggcgggcgtgcagcgcctgccgctgtgcgcattaagtccacagccaggctgggcagagcgcgacatggcagaactgtggcaatgttgcactgctgtcattcgcgccctgcttacccattctggcgtcagcggggaacaaattgtcggtatcggcatctccgcgcagggaaagggcttatttctacttgataaaaacgacaaaccgctcggtaacgccattttgtcctcggatcgccgggcgatggaaatcgttcgtcgctggcagaaagatggcatcccggaaaaactctatccgctgacccgacaaaccttatggaccgggcatccggtgtcgctgttacgctggctgaaagagcacaaaccagaacgctacgcgcaaattggctgcgtgatgatgacgcacgactacctgcgctggtgtttaaccggcgtcaaaggttgcgaagagagcaatatttctgagtccaatctctacaacatgggtcgcggggaatatgacccgtaccttaccgactggctggggatcgctgaaatcaatcacgccctgccgcctgttgtcggatctgccgaaatctgcggggaaatcaccgctcagacagccgtactgaccggtctgaaagcgggtacccccgttgtcggcggcctgtttgatgtggtttccaccgcactctgcgccggactcgaagacgaattcaccctcaatgcggtgatggggacctgggcggtgaccagcggcataacccacggtttacgtgacggtgaagcgcatccgtatgtctatggtcgctacgttaacgatggtcaatttatcgttcacgaagccagccccacctcttccggcaatctcgaatggtttaccgcacagtggggagaaatctcatttgctgagattaatcaggccgttgccagtttgccgaaagccggtggcgatctcttcttcctgccgttcctgtacggcagcaacgccggactcgaaatgaccagtggtttctacgggatgcaggccattcacacccgtgcacacctcttacaggccatctatgaaggggtggtgttcagccatatgacccatctcaaccggatgcgcgaacgttttactgatgtgcacaccctgcgcgtcactggcggcccggcgcactccgatgtctggatgcaaatgctggcggacgtcagcggtctgcgtatcgagctgccgcaggtggaagaaaccggctgctttggtgcggcacttgccgcccgcgtcggtaccggggtttatcgcgatttcagcgaagcccaacgtgacttgcgacacccggtacgcaccctgctgccggatatggccgcccatcagctttaccaacaaaaataccaacgctatcaacatctcattaccgcacttcagggttatcacgcccgcatcaaggagcacacattatgagtcgaccacttctgcaactggccctcgaccactcatcacttgaagccgcgcagcgcgacgtgacgcggttaaaagacagcgtcgatattgtcgaagcaggcaccattctctgtttaaacgaagggcttggcgccgtgaaagccttgcgcgaacagtgccctgacaaaatcatcgttgccgactggaaggtcgccgacgcgggtgaaacgctcgcgcaacaggcatttggcgcaggcgctaactggatgaccatcatctgcgccgcgccgctcgccacggtggaaaaaggccacgcgatggcgcaacgctgcggcggtgaaatccagatcgagctgttcggcaactggacgctggacgatgcccgtgactggcatcgtattggcgtgcggcaggccatttatcatcgtggtcgtgacgcgcaggccagcgggcaacagtggggcgaggccgatctggcacgcatgaaggcgctttccgatatcggccttgagctttccattaccggcgggattacccctgctgacctgccgctgtttaaagagatccgcgtgaaagcgtttattgccggacgggcgctggcaggcgcagcaaatccggcgcaagtggctggcgatttccatgcgcaaatcgactccatctggggaggcaagcgtgcgtaatcatccgttaggcatttatgaaaaagcgctggcgaaagatctctcctggccggagcggctggtgctggcaaaaagctgtggttttgattttgtcgaaatgtcggtggatgaaaccgacgaacggttgtcacgtcttgactggagcgccgcacaacgtgcttcgctggtcactgcgatgatcgaaacgggtgttgctattccgtcaatgtgcctgtccgcacatcgtcgttttccttttggtagccgggacgacgccgtgcgccagcgggcgcgggagattatgagtaaagcgattcgcctggcgcgcgatctcggcattcgtactattcaactggcaggttacgacgtctattacgaggatcatgacgaaggcacccagcaacggtttgctgaagggctggcgtgggcggttgaacaggcagcggcatcacaagtcatgctggcggtggagattatggacaccgcgtttatgaactctatcagcaaatggaaaaagtgggacgaaatgcttgcgtcaccgtggttcaccgtttacccggacgtaggcaatctcagcgcctggggcaatgatgttcccgccgaactgaaactgggcatcgaccgtatcgccgccatccacctgaaagacactcaacccgttaccgaacatagccccggacagttccgcgatgtgccgtttggcgaaggctgtgtcgattttgttggcatcttcaaaacgctgcatgagctgaactatcgcggatcatttctgattgaaatgtggaccgaaaaagccaaagagccggtgctggagattattcaggcgcggcgctggattgaagcgcgtatgcaggaggccggatttatatgttagagcaactgaaagctgacgtgctggcggcaaacctggcgcttcccgttcatcatctggtgacgttcacctggggcaatgtcagcgcgatagacgaaacgcggcaatggatggtgattaagccttccggcgttgagtatgaggtaatgaccgccgacgatatggtggtggttgagatagccagcggcaaggtggtggaaggcagcaaaaagccctcttccgacacgccaacgcatctggcgctttaccgtcgctttgcggagattggcggcatagtgcatacccactcgcgccacgccaccatctggtcgcaggtcggacttgatctccccgcctggggcactactcacgccgattatttttacggagccatcccctgcacgcgcctgatgaccgcagaagagatcaacggcgagtatgaataccagaccggcgaagtgatcattaaaaccttcgaagagcgtgggttgaacccggcacaaatcccggcggtactggtgcattctcacggcccgttcgcctggggaaaaaatgccgccgatgcggtgcataacgccgtggtactggaagagtgcgcctatatgggtctgttctcgcgccagcttgcgccacagctccctgcgatgcaaaacgaactgctggataagcactacctgcgtaagcatggggccaatgcctattacgggcagtagccatacctgagagtgcccggcaatacacgccgggcagcctttcacatcagaacagccccaacggtttatccgagtagctcaccagcaggcacttggtttgctggtaatgctcaagcatcattttgtgggtttcacggccaatgcctgattgtttgtagccgccaaacgccgcatgtgccgggtaagcgtgataacagttggtccacacgcgccctgcctgaatgccgcgccccatcttataggccagattaccgttgcggctccagacgcccgcgcccagaccatattgcgtatcgttcgccagctccagcgcttcttccatcgttttgaaggtggttaccgccagcaccgggccaaaaatctcctcctggaacacgcgcatattgttctgaccaaacagaatcgtcggttcgaggtagtagccgtctttcagttcgccttccagcagcttgcgtcgcccgccggtgagcacatcagcgccctcttttttaccgatatcaatgtagttgaggatggtttccagttgcccgtgagaaacctgcgcgcccatttgcgtcacgctgtcgagcgggttaccgctgcgaatgctttcgacacggcggatagcgcgttccataaagcgttcgtagatagactcctgcactaaagcacggcttggacaggtgcaaacttcgccctggttaaaggcaaacagtgcaaagccttccagcgctttatcgaaaaaggcatcttcttcatccatcacatcagcaaagaagatatttggcgatttgccgcccagctccagcgtcaccggaataatgttttgcgtggcgtattgcataatttgttggcccacttccgttgagccggtaaacgccactttggcgatgcgtttcgaggtcgccagatattcgccaatttccccacctgcgccgttgaccacgttcaccacccctggcggcagtaaatcaccgacgatttccattagcagcagtacagaaagcggagtaagacgtgcgggtttcagcaccacacagttgccagccgccagcgcgggagccattttccagctcgccatcagcagcgggaagttccacgggataatctgccccaccacgcctaacggttcatggaaatgataggccacggtttcgctatccacttcactgatcccaccttcctgcgcccgaatacacgaggcgaaatagcgaaaatgatcaatcgccagcggcacgtcggcagcactggtttcgcgaatgggtttgccgttatcccaggtttctgccgtcgctaaaagttcaaggttttgttccattcgatcggcaatcttaaacagaatcgccgcgcgatcctgcaccgaggtgtgcgcccatttatctttcactttatgcgcagcatccagcgccagatcgatgtctcgtttgcccgaagacgccacttcgcacagtagctgcccggtcaccggcgtcaggttctggtaatactcgccatcggcaggcgctacccattcgccaccgataaagttgtcgtagcgggcttttaatttgagggggaaaccatactcgccgggcttaatctgtgctgaagggggattattggtcatgatcgtctccttgctgtgtgaggtataacaagggtagacgtgactggcgaaatcttcgccagtcggtaacagctttacgacggctatcacgaatttacgggcaaaagctacagcgggtagtgtgcgacgtacactgcttgctggttattaattcttttctcttgcgcgaatccttctttaacaattgtccgtaaatcggtccgcgccgtattatccgagacgctcagactcacactaatttcagcaactgtgtactctttccccggattggcgagcatcacattcaggagcgttacctggcgcggattcaggcgtttaagcacaccagagctaaacagcacactatcgagttttgcgcttcgttgtgtaatttcatcgatatgctgctgccagttttgcagagcacgtttaatgacacccgcctgatattcaaggaaataagtcagatccataccatctgattcagtgtactggtagctggcggcatatttgaccggtgcagcatgaagcaaactgctgatggaaatatatttaaagacatcgtagcccgatttcagcatataccagtaaaacagcgcccgactggtgcgcccgttgccatcgcgaaatggatgttcatgggccagcataaaatgcagaatgcaggcacggaccaacggatgaatatacccttcatggctgtttaaccactggcaaactttttccagccgttccggtaacaatgccgcagcggacggttgatgcactatattgccatcatagtcggcgatcacaacatcatctgtttcacgaaattctcccggacgatatttcgcgtcattgattccacccataccaatggcatgtaactggcgaataagcgcaggtgtcagcggttctgcgagtaagtgcggaatttccgccatcagccgggcatttcccgcaatcatatgctcgtcttcagtgcgtggcgaccgccctgtttccagcatttttctcgccaccagcgttgtagtattcgcaccttccagctgggagctggtgatcggctcttccaggcgtaactggcttaactcggctccggccccgcgtaaccgttcagtctgatctttcagcgccagcgcggtagcacgtttgtcgacaagctcgcacgcttctgcaatcaccggggtaatgttgaatccggcctgttcacccgcttcattgcaataattaattcgttggatcgccgcgttgcgcgccagacgggtaagcgtccacgccacatcgacgttttctccttttttgatgcggtactgcaactcatcaaaaggcagataacgtcctttttcatcggtaacccggttaaagcgcaggtgggccaggagttcctcacccgataagtgtgataaaggaataagtccgggaggtgatttgatagccatgtgcttatctcaaaaaagcgcaatattgagatagtgtatagcaggaaagagaaactatctcaaaaaaagcaagttttgagatagttgaaaaagcggctgacaactcgccagccgttgtgggaatgatgattacatcgctgcgcgataaatcgccacaatttcttcgtgagttgcctgaatcgggttagtaaagccgcaggcatctttcagggcattagtcgccagaaccgcgaaatcttcttctttcacgttcaggtcgcgtaggcctgccgggatatccactttcttcgccagttcacggatggcgttaatgcaggcttcagcaccttccgcgtcgtttttacctgtcacgttcacgcccattgcagcggcacaatcacgcagacgtgcagcggcgactttgctgttgaatacctgaacatgcggcagcaaaacggcgttacatacaccgtgtggcaggttgtagaaaccgcccagctggtgcgccatcgcatgaacataacccagagaagcattattgaacgccataccggcgaggaactgggcataagccattgcttcacgcgctttcgcattactgccatcttcaacggctaacggcaggttttcggcaatcatggtcacggctttcagtgcacaagcgtcagtgatcggcgtggcggcaatagaaacatacgcttcgatagcgtgcgttaaggcatccatacccgttgcggcggtcagtgacttcggcataccaatcatcagagaggagtcattgacagaaagcagcggagttacatgtttatccacaatcgccattttgatgtgacgcgcttcgtcagtgatgatgcagaaacgggtcatttcagaggccgtacccgccgtggtgttgatggcgatcatcggcagctgcggttttgcagagcggtcaacgccttcataatcgcggatgtcaccgccgttggctgcaaccagcgcaataccttttgcgcagtcgtgtggagaaccaccgcctaaagaaatcacgctatcgcaattattttctttaagtaatttcaaacctgcggcgacgttttccgtggtggggttaggttgggtgccatcataaataacgctaaaaatattgcgttcttccagtgctttttgcacatcacccgccatacccaatttcgttaacatattgtcggtgacaattaaggtacgggtaaatccataatctgccatcatattcattgcatcattcaatgaatcagcaccaataacattcacggaaggaataaaaaaggttgaagctgccataacacactcctgaaagtgtaaaaaagggcgggcagcttactgaggattttcatttgaaaatatgatcaacattaccgtttattaaaatatttttaataaaaagcacgttacattcatcaaataacgtgccttcttaacattaataagaaattttgtattaattcatatttattatgaattaatcatttccttatttttccggaaataataatgcgtcgcgcaataaatgatcatttccacgacgacgcgtaaagccaatacggtcaaaatattccagaatctgaattgccagcttgcggcctacgcctaagcgatcgcggaaatccgccgcgcaggttgaaccgcattcctgatcgagatcgcggatcatattggcaaattcgacaatccgatcgttacggtaataacgatctttgacgatcgcagtaattatcccctgttgcgccgcctggcgtagcgtcaggcgcattgcctgctcgtcggttcccgtctcttttgccaggtcacgcacccaccatggctcgtcaccaaacagcggctctgctttttgccagatggcctgctgctcttcgctgaagcccgctttatgatccggcagatgcagccagccgtgatggctgtggatgtcgccgctttcgcgcatcttttcaatcagcaacagtaccagcgcgtcatcttccattggcaacgccatacgtcgcagacgttcgcgcccaggaccaggttcatcgcgatgttgctcatgataagtcgctaatgtgtcgagaattttccgctgccagcgggcggcaactggcgcattcaacaagctgtaaccagcctgaatataaccaggctgttgcagcagttcgcgcatcccttcgccgttgagctgccgtgcccaggcgaaatccgcaaggttaaccgcgccgcgttccagatgaacagataacgcatcggcatcgctctgcgcccgtgcaagagacgccagccattgcagatattccggcttacgcttaccgcggcgcggcgggttaagcatcaccacacgcgcccccgccagcgtgttgcgggccgagatatcgcgcagcactaagcgatcgttatccgccagccacagcggcgtgtcgaacaccagctcggcaaggttatcttccagcagcgaaacgcgtcccgtaacgtggctggcggcgtggtgaatatgcagcggctgccactgggtcagcggtgtatgggtttgaagctcgacaatcacccgtgtgaacggctccggcggcacatcggcaagcagccagtcgccacggttaatctgctctttttccgcatcacccgcgatgttaagcgcgatacgctgcccggcatgggcagtttctgttggctgattttgcgcatgtagcgcacgcacgcgcatcggtttatttacaccagtcagccatagtgaatcgcctaccttcacttccccgcttaacgccgtaccggtgacgaccagcccggcaccttttacggtaaatgcacggtcgatcgcgaggcggaaactatgttggctggcgtgttcacgttctggtaactgaagcagatgctcgcgcagggcatcaattccccgaccttcggttgctgcggtgataaacagttttgcctcagcaaaaccgtattcccgcagcacctcctttacctggcgttcaacctcatcaacacgcgcttcgtccacgcgatcggctttggtcagcgccactgtcagcatcgggttaccggtcagctgcaaaatcgccagatgctcacgggtctgtgccatcacgccgtcatcgcacgccaccaccaacagcgcgtgatcaataccaccaacgcccgccagcatgttggaaagaaacttttcatgaccgggtacgtcgataaaaccaggcacgcgaccatccggctgcggccagtaggcatagccgagatcgatggtcatgccgcgctttttttcttccggcagacggtcggcatttacgcccgtaatcgcctgcaacaaggttgttttgccgtggtcaacgtgtccggcagtcgcaataatcatttcaacaacatctccaaaaaccgttgctcatcttcaaggcagcgtaaatccagccacaatcgtccgtcataaatacgaccaatcaccggcactggcaattcacgccagcgggcggctaatgactcaaggtggctaccgcgtccatcatggggtgtaaacgttaatgccgcgctcggcaggcgatcaaccggcagcgaaccactgccaatctgcgaaagacatggcataacctgtaccgcaaactccgcgccgtaatgtgcggcaaggggagcctgtaaacgttgtgcctggatttgaatgacctctgcgctgcgggtaagcaggcgcagggtcggtaatttttcactcagcgcttcagggtgtaaataaagacgcaacgtggcttccagcgccgcaagggtcattttatccgcgcgtaatgcacgcttcagcgggtggctttgcagtcgggcgatcatctcttttttaccaacaataattcctgcctgcggcccgcctaacaacttgtcgccggagaagctcaccagactgacgcccgccgcaatcaactcctgcggcattggctctttcggcaaaccgtactggctaagatcgaccagcgagccactgcctaaatcagtcactacggggacatccagctctttgccgagcgccaccagttccgcttcatctatcgctttggtgaatccctgaatgctgtagttactggtatgtactttcatcaacagcgcggtattttcattcaccgcctggcgataatcattagcgtgcgtgcggttggtggtccccacttcgtgtagggtgcagcctgcctgacgcatgacatcaggaatacgaaacgcgccgccaatctccaccagttcgccgcgagaaaccaccacctctttcccgctggcagtggccgccaacatcaataacaccgccgccgcattgttattaacaatacaggcatcttccgcccccgtaatacggcacagcagctgcgccagcgcccgatcgcgatgtccgcgtccggcgtcgtccagatcgtactcgagggtcactggcgaacgcatagccttcgtaacggcttccaccgcggcttccgcctgtaaagctcgcccaaggttggtatgcagcacggttcccgtcaggttgatcaccggacgcagcgcgctttgcgcctctttcgtcaaccgggcatcgacttcttgcgcccagttttcacaccacgcgggcagcgtctggctgtcacgaatcacttctcgcgcttcgtcaagcatctgacgcagcaattccaccacgcgggtgtgaccataagtatcacgcaaagaaaggaaggagctatcgcgcaataagcgatcaatagccggaagttgactatagagggaacgcgtttcggttgtcataggaaacctggctgatcaaggccctctcacacggagaagggcgtttaacataaccacggattgtaacgtgagatgggtcaggaggacatatcgcgcatcaagcctttggcggttcggtgcgagcaaaactttcgcggctaaacaggttttcgaccagtttgactaagtgtgggcggtcgacacaccagcctggcgcaacgcggcggaaattgagatatccgacggcacaggcaatggcgatagtcgccagattgaccgtatcggttttgagtgtgccatcgaccagatatccttccagcacatccagactgcggttgattttctcacgctgacgtaacaattcatcttcagactgctgcgccgccggacgcgcctgttcacgcaccgataccagcccggcatccataatgccatccgccagcgcctcaattttgcgcacccgcaacgactccagcggatcacgcggcaacatcgccggagcaacattcattaattcaatatattcagcgatgatcggcgaatcaaaccagcattcgccctcttcggtcaccagcaccggcacttttcctaacgggttaaattgcgccacgccgttatccgcgttatagggcagttcattaataaattcgaacgttatgcccttttctaacaacagaatagaaagtttgcgtacaaacgggctggtgtagctaccgacgagtttcatgccgagtcctttgtgcgaggaaaaatatcagtatggctcaggctcgcgcaaaacacaggtgatacaagtctcaatgatccaaataaagataatgcatccaactggtcattcttagcagcactttccgcatcaccgaaacatggctgaaatggtcggagtaaactgccacctgggcgtagatgccgtcgggtaaggcatcgatatcagcgttagggtccagttcaatggttcccagcacaccgtccgtgccgggcacgaccgttaatgattgcaataccccctgcgcctgataagaaccgcctggcacgacaggtaaaatactggtcagtttgccgtgaaacacctgcccaggtagcgcgttaaacaccacttccgcatcatcgccgggtttcagacgtaacagcgagttttgccgaaattgggcgacaatttgccgtttttgctcggggatgaagaccatcaccggacgcagcggcaaggcagctgcgtatgtacctgggcggatcagtacctgagtgacgtagccattgctcggtgcgcgaatgacagtctgctcaaggttatattttgcttcagtaagttgcgctcttaagctcacaatctgcgattgctcgccgttaaccatactgtcgagctggctctggatctgcgcctgctccgccaccgagcctttcaccagcgcatcctgcgcgaggaaattttgccgcgcatcgtcgatgtcacgttccgagaacggattcaccgccgcctggctgcctttcagataacgttgataatttttaaacagacggtcgcgctccgctgaaacctgggtggtgttggcctgcgcttcagtgagctgcgcgcgcagcgtctttatattatgcgtcgccgtcatcaggtctgcctgaagcctgtcaactcgcgcctggtaacgaaccgggtcgagcttaaaaagcacctcgcccttctgaataagctgattatttttgtcggtgacttcagtaacaattcccgtcacctgtggcgtgatggggatcgctatcactgccttttgcgcggtaaaagtgtaagggtggttgtagttcatcaacaaaatcaaaccactcaccagaaacacgcctcccagcgccgccgtcgccagcgtccactgattcaccggaatgcggaagattttaaagaccgcccacgccagcgccacgtaagttaaaacaatcaatagatccataattagatctccggaaacgtggaatagtcagtctttttctcggcggcgagttggtgctccagccgggaaatccggtcagaaagtgcggcgatttccgcgtcagtcgttttctcttgcggcgtaacatgcgactgcatgccccagccgcgctccggttgatagagcgtcgcccagatccacaggaacggccagataacatgcagggtaaacaggcttacccagcccgccgtatgaatagcgtcggcatggggatggttgcgctttttggcaatcagataagggatgtcatgtatcgcgatgattccataaaaaatcaccagaaagacgaagatcagcactcccaacgcgaaatagtttagaaacatatctgcctcggattcacgtttatcagtgttgttttttggctggcagccagaagggagtcaggctgatattttgacaataatccgggttcgcgattctcgccataacaccaaagaataatttaagaggtgatgagttgcttagttacataacgattttatgacgaaggcataacatgctgtagatcacatcaggtgaacgccgtaagaaaatatcttgtgattcagatcacaaagattcaacaaaccatcaaaataaaaatgtgacataactcacatttaaatgccatttttagcgaaaatcgccgccttgttgcttttttacacaagcattttgtgatgaacatcacgtcaattacctctccaccccctacatttatgtgactgatatcacacaaaaggccgccgactggacagttaaccgattcagtgccagatttcgcagtatctacaaggtccggctacctctgccgccacattaacaaaaaacctcgggcttccagcctgcgcgacagcaaacataagaaggggtgtttttatgtcatccgatattaagatcaaagtgcaaagctttggtcgtttcctcagcaacatggtgatgccaaatatcggcgcgtttatcgcgtggggtatcatcaccgcgttatttattccaacagggtggttaccgaacgaaacgctggcgaagctggtcgggccgatgatcacttatctcctgccgctgctgatcggttataccggtggtaagctggtaggcggcgaacgtggcggcgtagtcggtgccatcaccaccatgggcgttatcgtcggcgcagatatgccgatgttcctcggctctatgattgcaggtccgctgggcggctggtgcattaagcacttcgaccgctgggtagacggtaagatcaaatccggttttgaaatgctggtgaataacttctccgcaggcatcatcgggatgatcctcgctattctggcatttctcggcattggcccggttgttgaagccctgtctaaaatgctggcggcgggcgttaacttcatggttgtccatgacatgctgccgctggcgtctatctttgttgaaccggcgaaaatcctgttcctcaacaacgccattaaccacggtatcttctcgccgctgggtattcagcagtcccatgaactgggtaaatccatcttcttcctgattgaagctaacccaggtccgggtatgggcgtgctgctggcgtacatgttctttggtcgtggtagcgctaaacagtctgcgggcggtgcggcaatcatccacttcctgggcggtatccacgaaatctacttcccgtatgtgctgatgaatccgcgtctgattctggccgttatcctcggtggtatgactggcgtgtttacgctgactatcctgggcggtgggctggtttctccggcatctccgggttctatccttgctgtactggcgatgacaccaaaaggtgcatacttcgctaacatcgcgggtgtgtgtgcggcgatggctgtctccttcgttgtctctgccattctgctgaaaaccagcaaagtgaaagaagaagatgatattgaagcagcaactcgtcgtatgcaggacatgaaagctgagtctaaaggcgcgtctccactgtctgcgggcgatgtgactaacgacctgagccacgtacgtaaaatcatcgttgcctgtgatgccggtatgggttccagtgcgatgggcgcaggcgtgctgcgtaagaaaattcaggatgcaggtctgtcgcagatttcggtcactaacagcgcgatcaacaacctgccgccagatgtggacctggtcatcactcaccgtgacctgaccgaacgcgctatgcgccaggttccgcaggcacagcatatttcgctgaccaacttcctcgacagcggcctgtacaccagcctgaccgaacgtctggttgctgcccagcgccatactgaaaacgaagtgaaagtgaaagacagtctgaaagacagctttgacgattccagtgctaatctgttcaaactgggcgcggagaacatcttcctcggtcgcaaagcggccaccaaagaagaagcgattcgttttgctggcgagcagctggtgaaaggcggttacgttgagccggaatacgttcaggcgatgttggatcgtgaaaaactgaccccgacttatctgggtgagtctatcgcggtgccacacggtacggttgaagcgaaagatcgcgtactgaaaacgggcgtggtgttctgccagtatccggaaggcgtgcgcttcggtgaagaagaagatgacattgcccgtctggtgattggtattgctgcccgtaacaacgagcacattcaggttatcaccagcctgaccaatgcactggatgatgagtctgtcatcgagcgtctggcacacaccaccagcgtggatgaagtgctggaactgctggcaggtcgtaagtaatccattcccaccctctccgcatgaagaaggtgaggctaattgcctgatgcgcttcgcttatcaggcctacaacataaagcacaatttgttttgtcggtcggataaggtgtttacgccgcatccggcagtcggtacacaatgcctgatgcgacgctgacgcgtcttatcaggcctacaggtcagtgccaaacacgtaggccggataaggcgtttacgccgcatccggcaaaaagcccctctcctcacggagagggtttgggtgagggaaaagcctcaccccagccctctcgggtaaaaacattgatgaaggttaatactatgaaagcattacattttggcgcaggtaatatcggtcgtggctttatcggtaaactgctggcggacgcgggtatccaactgacgtttgccgatgtaaatcaggtggtacttgatgccctgaatgcccgtcatagctatcaggttcatgtggtcggcgaaaccgagcaggtggataccgtttctggcgtcgatgccgtcagcagcattggcgatgatgtcgttgatctgattgctcaggtcgatttagtcactaccgccgttggccctgtcgtgctggaacgtattgctccggccatcgccaaagggctggtgaaacgtaaagaacaaggtaatgaatccccactgaacatcatcgcctgtgaaaacatggtccgcggcaccacgcagctgaaaggccatgtgatgaacgccctgccggaagatgccaaagcgtgggtagaagaacacgttggctttgttgattccgccgttgaccgcatcgtaccgccttcggcttcggcaactaacgatccgctggaagtgacggtagaaaccttcagcgaatggattgtcgataaaacgcagttcaaaggcacgctgccaaacatccctggcatggaattaaccgacaatctgatggcatttgtcgaacgtaaactcttcaccctgaatacaggtcatgctataaccgcgtacctcggaaaactggccggtcatcagaccattcgtgacgcaattctcgacgagaaaatccgcgcggtggtaaaaggggcaatggaagaaagcggcgcggtactgatcaagcgctacgactttgatgctgacaaacatgcggcatacatccagaaaatcctcggtcgtttcgagaacccgtacctgaaagatgatgtagaacgcgtaggccgtcagccgctgcgtaaactgagtgctggcgaccgtctgatcaagccactgctcggaaccctggaatatggtctgccacataaaaacctgattgaaggtattgccgctgcaatgcacttccgcagtgaagatgacccgcaggctcaggaactggcagcgctgattgccgacaaaggcccacaagccgcgctggcacagatttccggtcttgatgccaacagcgaggttgtatccgaggcggtaaccgcttataaagcaatgcaataatggtggaccaggcgcaggataccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagcttttgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcttttaccgacgacgaaatccttggaccctttggtgaactgcattgcgtggcggcgttaccaccgccgccacagtttgaacctgcagactccagtttgtatgcaatgcaaattcagcgttaccaacaggctgtacgatcaacaatggtcctttcactgacagagctgatttcaaaaatcagcttaaaaaaagcctttcaaaagtaagtactttcgcttacttctcctctacctgtttcggacgataaagctgacgataatactccagacgttgtagatataacggcacgctttcatcaggtattccggacggaatcgcgttacggggaggtagttttttcagatactcccggaacgcctggctggatgccatgaaatctacggctttatcgataagaagcggaacgttttcacctaatttgcccatgatgatatctccgtattaccccgcgccgggaatgcgcggccgccaattttagtttagatcccgatataaatgacattaaggaaaacgtgctcaatcctcaataatcacctgcttctgttgactatcttttttctttaaatttcttaactaatcaatgtattgggtgattttttaacgcattaatggttacaatctggaactattacaatgccatcagttgtgaacaaagcacctggtcgcgcatactagaggctataaatttatctctatcagaagtcatcacatgaaagaagtcgaaaaaaacgaaatcaaacgtctcagcgatcgtctggacgccatccgtcaccagcaggccgatctatcgctggttgaagccgcagacaaatatgccgaactggaaaaagagaaagccacgctggaagcagaaattgctcgcctgcgcgaagttcacagccagaaactcagcaaagaagcgcagaaactgatgaagatgccgttccagcgtgcaatcaccaaaaaagagcaggctgatatgggcaaactgaaaaaaagtgttcgcggactggtggttgtgcacccaatgaccgcgctgggccgtgaaatgggcctgcaaaagatgacagggttctcaaagactgcgttttaagttcctttctcgtcgctgtaatcacagcctctcaccatttactcgctcctgctggcacatgcaggagcctgtttcagagatcgaatatttataacgttcttaacattatatattcaatctcctctattctttttagcgcacatgccaggctaaattctgaaaatcaggtacaaattaaagaacgatgtatcaatattaacaatgaatttccgcatatcaatgcttgaaacataattaattatttaaatttttcaatcagcttcgcaaattccataataaaacatcactcaactgaatatttatctttccccgccctgtgcctttatccggtgaaacatttgacatcgattgacaccgatcattaaaatccgcgcgattaatattattggctacaaactgaaatcgtttgacatttaataaaatattcgcacaaccaattaatacaaaaactctctaacaaatttattttgcggatatgccccactccaatcattcataaaaaaaatgattgtgccgtaattatcaactgtatcgggattatgaaaaggaattcatcctatgaacctaaagaaaacactgttaagcgtgttaatgatattgcaactttgcttattggtagggtgtgactatattgaaaaagcgagtaaggtcgacgatctcgttacacagcaagagttacaaaaaagcaaaatcgaggcgcttgaaaaacaacaataactcgacaagcgcaagatagaacactttgaaaaacaacaaattaccatcataaacagtaccaaaacgctcgctggcgtggtgaaggcagttaaagacaaacaggacgaatttgtctttacagaatttaacccggcacaaacccaatacttcattttaaataacggttctgttggtttggcagggaaaatactgtctattgacgcagtagaaaacggcagcgttattcgtatttcactggttaacttattaagtgttcctgtatcaaatatgggtttctacgcgacatgggggggagaaaaacccaccgacatcaacgcattagcaaaatggcagcaattgctatttagtacctcaatgaactcctccctgaaattattaccaggtcaatggcaagacattaatttgacgctaaaaggtgtctcgcccaacaacctcaaatatctgaaattagccatcaacatggcaaatattcagttcgaccgtcttcaacctgctgaatctccacagcggaaaaacaaaaaataaatgcagcttctgcgcttatatcaaggaatagagagcatcaataatgaacaaaatatttaaagttatctggaatccggcgacaggcagttacaccgttgccagtgaaacagcaaaaagtcgtggtaaaaaaagcgggcgcagtaagctgttaatttctgcactggttgcgggtgggttgctgtcttcttttagcgtatgggcaaacgccgggaatgacgacggtcagggtattggaacaggcacaggctgggttgctattggtgaaagcgcaaaggcaaccgcctatacagatagtaatggtgccagtactgcggtcggttataaatctaacgcccagggagtctggagttccgctattggtgcacttaccagtgcacttggtgattcttcaatggccttcggtgttaatgccgtttcaaccggtcaacgaagtattgctatgggtgcatcatcaagctcactcggtgagtattcaatagcgcttggacgatatgcaagttcgggtggtatgttttcgctcgcgcaaggggacagatccaatgcagctggtttgaacgccactgcggtggggagtaacagtaatgcggcgggcgcgaaagctattgcgctaggaaatgcagctaaagctactgaaattatgagcattgctcttggtgacactgccaatgcctcgaaagaatattctatggcgctgggagtaagtagcgccgcatctgcggctaacgcgattgccgtaggccgcaacagtgctgcggcaggcgtagacagccttgccttaggtagactatccgtagccagcgcagcaaacgccattgctatgggtgcagagagcgaagctgctgaaaatgcgacggctattggcaataacgcgcatgcaaaaggggtgaatagcatcgcgatgggctccgggagcattgccgataaagtcaatactatcgcgttgggtaatggcagccagtctctggcagataacgcaattgctattggtcagggcaacaaggctaatggcactgatgctatcgctctgggtaatgctagcctgtcgagcggcttaaactcgattgccctgggcaagaccagtgttgtcactggcgataatagtcttgcgcttggtagtaataccaatgccaatggtattaactctgtcgcgctaggtgcagattccattgcggatcaagacaattccgtttctgtcggcagtagctcattacaacgcaagatcgttaatgtaaaaaatggcgcgatcaaggctgacagccacgacgccattaatggctcacagctttatgccatcagcgactcaatagccaaaaggcttggaggaggctcatcggtaaaccctgacgacggtacagttaacgcaccaacctacaatttaaaaaatggtaacaaaaataacgttggcagtgcgctcactgtacttgatgaaaacaccctgcaatgggaccaaatcaaaggcaaatacagcgccgttcatggtagctcaacgaccagcgtaatcactgatgtggcgaacggtacgatttcagcagccagtaaagatgcggttaacggctctcagttgtatgacctgcagcaggatgctctgttgtggaacggcacagcattcagtgccgcgcacggcaccgaagccaccagcaaaatcactaacgtcaccgctggcaacctgactgccagcagcactgacgccgttaacggctctcagctcaaaaccaccaacgacaacgtgacgaccaacaccaccaacatcgccactaacaccaccaacatcaccaacctgactgacgctgttgacagtctcggtgacgactccctgctatggaacaaaacagctggcgcattcagcgccgctcacggcactgacgccaccagcaagatcaccaatgtcaaagccggtgacctgacagctggcagcactgacgccgttaacggctcccagctcaaaaccaccaacgataacgtgtcgaccaacaccaccaacatcgccactaacaccaccaacatcaccaacctgacggattccgttggcgaccttaaggacgattctctgctgtggaacaaagcggctggcgcattcagcgccgcgcacggtaccgaagctaccagcaagatcaccaacttactggctggcaagatatcttctaacagcactgatgccattaatggctcacaactttatggcgtagcggattcatttacgtcatatcttggtggtggtgctgatatcagcgatacgggtgtattaagtgggccaacctacactattggtggtactgactacactaacgtcggtgatgctctggcagccattaacacatcatttagcacatcactcggcgacgccctactttgggatgcaaccgcaggcaaattcagcgccaaacacggcattaataatgctcccagtgtaatcactgatgttgcaaacggtgcagtctcgtccaccagcagcgacgccattaacggttcacaactttatggtgttagtgactacattgccgatgctctgggcgggaatgctgtggtgaacactgacggcagtatcactacaccgacttatgccatcgctggcggcagttacaacaacgtcggtgacgcgctggaagcgatcgataccacgctggatgatgctctgctgtgggatacaacagccaatggcggtaacggtgcatttagcgccgctcacgggaaagataaaactgccagtgtaatcactaacgtcgctaacggtgcagtctctgccaccagcagcgatgccattaatggctcacagctctatagcaccaataagtacatcgctgatgcgctgggtggtgatgcagaagtcaacgctgacggaactatcactgcaccgacttacaccattgcaaataccgattacaacaacgtcggtgaagccctggatgcgctcgataataacgctctgctgtgggatgaagacgcaggtgcctacaacgccagccatgatggcaatgccagcaaaatcaccaacgttgcggctggtgatctctccacaaccagtaccgatgctgttaacggttcccagttaaacgcaaccaatattctggttacgcaaaatagccaaatgattaaccagcttgccggtaacaccagtgaaacctacatcgaagaaaatggtgcaggtattaactatgtgcgtaccaatgataccggtttaaccttcaccgatgccagcgcagcaggtattggctctaccgctgtggggtataacactgttgccaaaggcgatagcagcgtggccatgggttataactcttttgccaaaggcgatagcagcgtggccatcggtcagggcagctacagcggcgttgatacgggtatcgctctgggtagcagctccgtttccagccgtgtaatagttaaaggttctcgtaacaccagcgtatcggaagaaggtgttgtgattggttatgacaccacggatggcgaactgcttggtgcattgtcgatcggtgatgatggtaaatatcgtcaaatcatcaacgtcgcggatggttctgaagcccatgacgctgttacggttcgccagttgcagaacgccattggtgcagtcgcaaccacaccaaccaaatactatcacgccaactcaacggctgaagactcactggcagtcggtgaagactcgctggcaatgggcgcgaaaaccatcgttaatggtaatgcgggtattggtatcggcctgaacactttagttctggctgatgcgatcaacggtattgctatcggttctaacgcacgcgcaaatcatgccgacagcattgcaatgggtaatggttctcagactacccgtggtgcacagaccaactacactgcctacaacatggatgcaccgcagaactctgtgggtgaattctccgtaggtagcgaagacggtcaacgtcagatcaccaacgtcgcagcaggttcggcggataccgatgcggttaacgtgggtcagttgaaagtaacggacgcgcaggtttcccagaatacccagagcattactaacctgaacactcaggtcactaatctggatactcgcgtgaccaatatcgaaaatggcattggcgatatcgtaaccaccggtagtactaagtacttcaagaccaacaccgatggcgcagacgccaacgcgcagggtaaagacagtgttgcgattggttctggttccattgctgccgctgataacagcgtcgcgctgggcacgggttccgtagcagacgaagaaaatacgatctctgtgggttcttctaccaaccagcgccgtatcaccaacgttgctgccggtgttaatgccaccgatgcggttaacgtttcacaactgaagtcttctgaagcaggcggcgtgcgctacgacaccaaagctgatggctctatcgactacagcaacatcactctcggtggcggcaatagcggtacgactcgcatcagcaacgtttctgctggcgtgaacaacaacgacgcagtgaactatgcgcagttgaagcaaagtgtgcaggaaacgaagcaatacaccgatcagcgcatggttgagatggataacaaactgtccaaaactgaaagcaagctgagtggtggtatcgcttctgcaatggcaatgaccggtctgccgcaggcttacacgccgggagccagcatggcctctattggtggtggtacttacaacggtgaatcggcagttgctttaggtgtgtcgatggtgagcgccaatggtcgttgggtctacaaattacaaggtagtaccaatagccagggtgaatactccgccgcgctcggtgccggtattcagtggtaatgatccattaacaaatgggtacgccacattgcctgatgcgctacgcttatcaggcctacggggtgattcagcactcccctgtaggccggataaggcgttcacgccgcatccggcaagataaggcgcaccagatcaacaatctgagggcaattctctgatgggaattgcccttttctttattacctctctcccagaattggccctaccaattcttcgcttatctgacctctggttcacaattccccaatcaaaactcacatcaatgttgccaatgcataacatttagttaactatccattgtcattatccctacacaacacaattggcagtgccacttttacacaacgtgtgacaaggagatgagcaacagactcattacacggcgtgtgtggactgcaggagacctgcaatgaatctctggcaacaaaactacgatcccgccgggaatatctggctttccagcctgatagcatcgcttcccatcctgtttttcttctttgcgctgattaagctcaaactgaaaggatacgtcgccgcctcatggacggtggcaatcgcccttgccgtggctttgctgttctataaaatgccggtcgctaacgcgctggcctcggtggtttatggcttcttctacgggttgtggcccatcgcgtggatcattattgcagcggtgttcgtctataagatctcggtgaaaaccgggcagtttgacatcatccgctcgtctattctttcgataacccctgaccagcgcctgcaaatgctgatcgtcggtttctgtttcggcgctttccttgaaggagccgcaggctttggcgcaccggtagcaattaccgccgcattgctggtcggtctgggctttaaaccactgtacgccgccgggctgtgcctgattgttaacaccgcgccagtggcatttggtgcgatgggtattccgattctggtcgccgggcaggtaacaggcatcgacagctttgagattggtcagatggtggggcgtcagctgccgtttatgaccattatcgtgctgttctggatcatggcgattatggacggctggcgcggtatcaaagagacgtggcctgcggtcgtggttgcgggcgggtcgtttgccattgctcaatacctcagctctaactttattgggccggaactgccagacattatctcttcgctggtatcgctgctctgtctgacactgttcctcaaacgctggcaaccagtgcgcgtattccgcttcggtgacttaggggcgtcacaggttgatatgacgctggctcacacaggttacacggcaggtcaggtgctgcgcgcctggacaccgttcctgttcctgaccgccaccgtaacgctgtggagtatcccgccgtttaaagccctgttcgcttcaggcggtgcgctgtatgagtgggtgatcaacattccggtgccgtacctcgataaactggttgcccgtatgccgccagtggtcagcgaagcgacagcgtatgccgccgtgtttaagtttgactggttctctgccactggcaccgccattctgtttgctgccctgctctcgattgtctggctgaagatgaaaccatctgacgctatcagcaccttcggcagcacgctgaaagaactggctctgcccatctactccatcggtatggtgctggcattcgcctttatctcgaactattcaggactgtcatcaacactggcgctggcactggcgcacaccggtcatgcattcaccttcttctcgccgttcctcggctggcttggggtattcctgaccgggtcggatacgtcatctaatgctttgtttgccgctttgcaggctaccgccgcacaacaaattggcgtttctgacctgttgctggttgcagccaacaccaccggtggtgtcaccggcaaaatgatctctccgcaatctatcgctatcgcctgtgcggcggtaggtctggtgggcaaagagtctgatttgttccgctttactgtcaaacacagcctgatcttcacctgtatggtgggcgtgatcaccacgcttcaggcctatgtcttaacgtggatgattccttaatgattgttttacccagacgcctgtcagacgaggttgccgatcgtgtgcgggcgctgattgatgaaaaaaacctggaagcgggcatgaagttgcccgctgaacgtcaactggcgatgcaactcggcgtgtcgagaaattcactgcgcgaggcgctggcgaaactggtaagcgaaggtgtgctgctcagtcgacgtggcggcgggacgtttattcgctggcgtcatgacacatggtcggagcaaaacatcgtccagccgctgaaaacgctgatggccgatgatccggattacagtttcgatattctggaagcccgatacgccattgaagccagcaccgcatggcatgcagcaatgcgcgccacacctggcgaaaaagaaaagattcagctttgctttgaagcaacgctaagtgaagacccggatctcgcctcacaagcggacgttcgttttcatctggcgattgccgaagcttcacataacattgtgttgctgcaaaccatgcgcggtttcttcgatgtcctgcaatcctctgtgaagcatagccgccagcggatgtacctggtacccccggttttttcacagctgaccgaacaacatcaggcggtcattgacgccatttttgccggtgatgctgacggggcgcgtaaagcaatgatggcgcaccttagctttgttcacaccaccatgaaacgattcgatgaagatcaggctcgccatgcacgtattacccgcctgcctggtgaccataatgagcattcgagggagaaaaacgcatgattatttccgcagccagcgattatcgcgccgcagcgcaacgcattctgccgccgttcctgttccactatatggatgggggggcatattctgaatacacgctgcgccgcaacgtggaagatttgtcagaaatggcgctgcgccagcgtattctgaaaaacatgtctgacttaagcctggaaacgacgctgtttaatgagaaattgtcgatgccggtggcgctaggtccggtaggtttgtgtggcatgtatgcgcgacgcggcgaagttcaggctgccaaagcagcagatgcgcatggcattccgtttactctctcgacggtttccgtttgcccgattgaagaagtggctccggctatcaaacgtccgatgtggttccagctttatgtgctgcgcgatcgcggctttatgcgtaacgccctggagcgagcaaaagccgcgggttgttcgacgctggttttcaccgtggatatgccaacaccgggagcgcgttatcgtgatgcgcattctgggatgagcggcccgaacgcggcaatgcgccgctatttacaggcggtgacgcatccgcaatgggcgtgggatgtgggcctgaacggtcgtccgcatgatttaggtaatatctcggcttacctcggcaaaccgaccggactggaagattacatcggttggctggccaataacttcgatccgtccatctcatggaaagaccttgagtggatccgcgacttctgggatggcccgatggtaatcaaagggatacttgatccggaagatgcgcgggatgcagtacgctttggcgctgacggaattgtggtttctaaccacggcggtcgtcagttggacggcgtgctctcttctgcgcgtgccctgcctgctattgcagatgccgtgaaaggtgatatcgccattctggcagatagcgggattcgtaacgggctggacgttgtgcgtatgatcgcgctcggtgctgataccgtactgctgggccgcgctttcctgtatgcgctggcaacagcgggccaggcgggtgtagctaatctgctaaatctgatcgaaaaagagatgaaagtggcgatgacgctgactggcgcgaaatcgattagcgaaattacgcaagattcgctggtgcaggtgctgggtaaagagttgccggcggcattggctccgatggcgaaagggaatgcagcttaagggttagacgaatatctgctatcctgcccccgcactaagggggcagtatgctaaacatcgtactttacgaaccagaaattccgccaaatactggcaacatcatccgtctttgcgctaataccggctttcgtctgcatatcatcgaaccgatgggatttgcctgggacgataagcgcctgcgccgcgcggggctggactatcacgagtttaccgccgttacgcgtcatcatgactatcgcgcgtttctcgaagcagaaaatccccagcgcctgtttgccctcaccacgaaaggtacgcctgctcacagcgccgtaagctatcaggatggcgactatctaatgtttggcccggaaacgcgcggcctgccagcgagcattcttgatgccctgcccgctgaacaaaaaattcgtattccaatggtgccggacagccgcagcatgaacctgtccaatgcggtgtcggtggtggtgtatgaagcctggcgccagctggggtatccgggagcggtgttgagagattaagatgcggtaggccggataaggcgttcacgccgcatccggcacgatcacagaatgtcagatcccatcaccatactcaaacgtatggttaatgccgttgaaatgctgatccatatccattgacggtttatcgctatccggcttgccgacaatgcgtgccggaacgccagcggcagtagtgtgcggcggcaccggttgcagcaccacggaacctgcgccaatcttcgcgccgcgcccaacttcaatattaccgagaattttcgcgcctgcgccaatcatcacgccttcacgaattttcgggtgacggtctccgccagatttacccgtaccgccaagggtaacggattgcagaatcgatacgtcgttttcaatcaccgccgtttcaccaacgacgatgcctgtcgcgtggtcgagcatgataccgcgaccaatttttgctgccgggtgtatatcaacctggaacgttacagagacctggttttgtagaaaaatagccagcgcgcgacggccctgattccacaaccagtgaccgatgcgatacgcctgcaaagcatgaaaacccttcagatatagcaacggggttgagtatttatccaccgccgggtcacgggtacgcaccgcctgaatatcacaggccgcagaggcgatcatttccgggtcggcggcgtaggcttcttccaccacttcacggatagcaatagccggcataatgggcgatgacagcttgttcgccagcatgtagctcagtgcactgccaaggttttcgtgcttgagtagcgtcgcgtggtaaaaactggccagcattggctcacagtccgccagcgttctggcttcagctttaatattgttccagacaatttccagttcttcacacgacattgcttactccacacgataagataatgaccgacccgttctgcgcgggccgggtcatagtggtaacaaaggttccctgggtttagtggctgctgcgctcgtccttgcgtgcacgacctagtaaagtcaatgctgcctcgcgcgcgttttttccgcaatataatacttgataaatttcctcggttattggcatttcaacgccgaagcgatgcgccagttcgcggacttctttcgtattgcggtagccttccaccacttgaccaattttctcctgcgcgctttgtacatccatgccctgaccgagcatcatgccaaaacggcggttacgcgactggttgtcggtacaggtaagcaccagatcgcccagccccgccatgcccataaaggtggcaggatcggcacccagcgccgcgccaagacgcgacatctcagccagcccacgagtgatcagcgccgtacgcgcattcgcgccaaaaccgataccgtcggacatccccgcgccaatggcaatgacgtttttcaccgcgccgccaagctgcacaccgatgaaatccgggttgctgtaaacgcggaaacttttgccacagtgcagcaattgctggaggtcatcggcaaaggtctggtccgtcgaggccagcgaaatggccgtcggtaaacctgccgccagttctttcgcaaacgttgggccagagataaccgccagcggaatttgatcgcctaaggcctcacgcgccacgtcctgtaacagacgtccggtttctgcttccagccctttggtcgcccacaccagacgcgcatcaggacgcatcagcggtttaatctggcgcagcacttcaccaaagacatggctgggtacgacgacgagaatattacggctggctgccagcgcagtggcgagatcgctttcaagatggagcgtatcgggaaaaggcacatcggggagaaacgcggcgttacagcggtcgcgttcaagcgttgcgatatgttcagggtcatggccccagaggacaacctcgtggccatttcttgccagggtaatggcaagagcggtgccgtacgagccggcaccgatcacagtcattgaagcattacgttggttcatcaggcatcctgatgttcttcagtaccttcgccagcctgctgctgcaaatagttcatgaacagcgcatcgaagttaaccggcgcaaggttcagttgcgggaatgtaccgcgggataccatgctggtgatgcactcacgagcatacgggaacagaatgttcgggcagtatgcgcccaggcaatgtgccatctgggtgccttcgatacccgcgatggagaaaataccgccctgctgaacttcacacaggaacgcggtttcttcgcccagggaggccgttacggtaacacgcagtaccacttcgtaaacgtcatctgccagttgagtagatgccgtatccagatcaagtttaacttctggttgccaatctttctggaaaacgtgcggcgcgttcggcgcttcgaaagaaatatccttggtataaatacgttggatctggaaagtcatttcggtgttgttttgttctgacatgtgtagaaaacccttaagtgttgtccttaaaatactgcgcaatgtaatgccaacgttcacacgttatttcagcaggggatccagtccaccacgtgcatccaatgcatacaagtcatcacagccaccaatgtgctgtgcgtcaataaaaatctgtggaaccgtagtgcgaccgctgcgtttgatcatctcttcacgcttagcggcattgccatcgatcggcaactcctgaaaactcacgcccttgctgctcagcagtgcttttgcacgatggcaatacgggcaggtttctttggtatagatttcaacattggccataaattagctcctgttttttaccctgaaatttcatgttgcagggcggcagcaaaatggagtgtccccagaagcttatatcaataagtcgctgggggcctaattgcagctaacggcctgcatcatgaaaaacggcaggtaaattatttgccgcgcaccaaaggcaagttttcgccagcccagccagcgacgccttctttcagtacgaatacttgcgcaaaaccagctttcgtcagcgcgtttgcaggctcctggcactgcatgccagaaccatctaccacgataaccggtttgtctttgtgcttctcaagctcaccaacattgttggctttgatttcgctcggcaacaggttgatagaacctgcgatatggcctttacggaagtcatcacgctgacgtaaatccacaaccacagcgtcttctttgttgatcagacgcgtagcttcaccacgagtaatcaccttcactttcgaggtcaggctcttaaacgtagtcacaagaaccgccaccagtaacgcgatccaggcgatactcagtatgggatgacggccaacaaattgcataatttcttgcatggggggtaacaactcccgacgtagtgattaaaaaaaccaggaaaggagtatacctgcgcagtgcggcaaatacagccagcgcgttaactggaatgcaattttgcggggcgctacgaaaaaaaagcgtaaatctggcatctgcttgccgcgagcggtcgtatattttgatcttcagaggctattttatcgattcagctgtagtaaaattacgcaaattttgactcttgagtatgaggttgtcgcaatgtcggtttctaaaaaacctatggtactggtgattctggatggctatggctatcgcgaagaacagcaggataacgccatttttagtgctaaaaccccggtaatggatgcactgtgggccaatcgtccgcataccctgatcgacgcttccggtttggaagtcggtctgcctgaccgtcagatgggcaactccgaagtaggccacgttaacctgggtgccggccgcatcgtgtatcaggacctgactcgtctggacgttgaaatcaaagatcgcgctttctttgctaatccggtgttgactggtgcagtagataaagcgaaaaacgcaggcaaagcagtacacattatgggtctgctctccgcaggtggtgtacacagccacgaagatcacatcatggcgatggtagaactggcagctgaacgcggcgcagaaaaaatctacctacacgcattccttgacggtcgcgacactccgccgcgcagtgctgaatcctcgctgaaaaaattcgaagagaaatttgccgcgctgggtaaaggccgcgtagcgtccatcattggtcgttactacgcgatggaccgcgataaccgttgggatcgcgttgaaaaagcttatgacctgctgactctggcgcaaggtgagttccaggccgataccgccgttgccggtttgcaggctgcttatgctcgcgacgaaaacgacgagttcgtgaaagcgaccgttattcgtgcagaaggtcagccagatgcggcaatggaagacggcgatgcgctgattttcatgaacttccgtgctgaccgcgcgcgtgaaatcactcgtgctttcgtgaacgctgatttcgatggcttcgcgcgtaagaaagtggttaacgtcgatttcgtgatgctgaccgaatacgctgccgacatcaaaaccgcagtggcttacccacccgcttccctggttaacaccttcggcgagtggatggcgaaaaacgacaaaactcagctgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggcaatcaagagcggcaaatacgacaccattatctgtaactatccgaacggcgacatggtaggtcacaccggggtgatggaagcggcggttaaagcggttgaagcgctggatcactgcgtggaagaagtcgcgaaagcggttgagtccgtgggtggacaactgctgatcaccgctgaccacggtaacgctgaacagatgcgcgatccggcaacgggtcaggcacacacagcacacaccaacctgccagttccgctgatttacgttggtgataagaacgtgaaagcggttgaaggcggcaaactttctgacatcgcgccgaccatgttgtcgctgatgggtatggaaatcccgcaagagatgactggtaagccgctgttcatcgtggaataatccctccccatgaggggaaaggcgattaataccatgacacgggccgtgaaaccgcgcaggtttgcaatcaggcccatcatctacgccagcgttctgagcgctggcgtattgttgtgcgccttttccgcccacgcggatgagcgtgaccaactcaaatccattcaggctgacatcgccgcgaaagagcgcgcggtacgccaaaagcaacaacaacgcgcaagcctgctcgcacaattgaaaaagcaggaagaagcgatctctgaagccacccgtaaactgcgcgaaacgcaaaacacgcttaatcaactgaataaacagattgatgagatgaacgcgtcgattgccaaactagagcagcaaaaagccgcccaggagcgcagcctcgccgcgcaactggatgccgcgtttcgtcagggtgaacataccggtattcagctgattctcagcggtgaagaaagccagcgtgggcagcggttacaggcttatttcggctatctcaaccaggcgcgacaagaaaccattgctcagttgaaacaaacgcgtgaagaagtcgctatgcagcgtgccgaactggaagagaaacagagcgagcaacaaacgcttttatatgagcagcgcgcccaacaggcgaagctgacccaggcgttgagcgagcgtaagaaaacactggcagggctggagtcttccatccagcaaggtcagcaacagttgagcgagctgcgcgccaacgaatcccgtctgcgtaacagcattgcccgtgcggaagccgcggcgaaagcgcgtgctgaacgtgaagcgcgcgaagcccaggcggttcgcgaccgccagaaagaagcgacgcgcaaaggcaccacctacaagccgaccgaaagcgaaaaatcgctgatgtcccgtaccggtggtctgggcgcaccgcgcggtcaggcattctggccagttcgcgggccgacgctgcatcgctatggcgaacagctacagggtgaattacgctggaaagggatggtgattggtgcctctgaaggtactgaagttaaagcgattgccgacggccgggtgattctggctgactggctgcaaggctacggtctggtggtggtggttgagcatggtaaaggcgacatgagtctttacggctataatcagagcgcactggtgagcgttggttcgcaggttcgcgcgggccagccaattgcactggtgggcagcagtggcggtcagggtcggccttcactctatttcgaaattcgccgccagggtcaggcggtcaatccacagccgtggttgggaagataagttttgtttccatttcgtcgtaacgttcttgcatttgccgctctgttggcgctctcctcccccgtaattgctggcaaacttgccatcgtcattgatgattttgggtatcgcccgcacaacgaaaaccaggtgctggcgatgccttccgctatctccgtcgctgtattacccgattcaccgcacgccagagagatggcgaccaaagcacataacagcggtcacgaagtgttgattcatctaccgatggcaccactgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcgctggagcgttacaatctttacttcctcgacagcgtaaccatcggtaatacccaggcgatgcgcgccgcgcaaggcactggcgtgaaggtgatcaaacggaaggtgttcctcgacgattcgcaaaatgaagcggacatccgtatgcaatttaatcgcgcaattgacctggcacgtcgcaacggttcaaccattgccattggacatcctcacccttcaacggtacgcgtgctacaacagatggtttataacctgccgccagacattacgctggtgaaagccagcagcttgttgaatgaaccgcaggttgatacgtctacaccgccgaaaaacactgtgcccgacacaccgcgtaatccattccgtggcgtgaagctgtgcaaaccgaagaagccgatagaacctgtttatgctaatcgcttctttgaagtattaagcgaaagcatcagccagagcacgctgatcgtttacttccagcatcagtggcaaggctggggcaaacagcccgaatcggcaaaacttaacgctagcgcaaattaaaggcgctacgcgtaatgcgatggtgcgaccgcgttttgtcgcgccattgccataagcggaaagaccacagtaacgcctggtaacccaccttcacgctgcgcacattggtaatcaggcgcttatacataccggaagtaaatatctcagcaatcatccgttggcgggtaataatatccggctctttgcgcaccgcatggcaaacacgcaatgcttcgtaagttatttgctgatgaaattccggataaatcgtaattttgtcggcataatttcgatttaatttctccagcaggcgggtaatcttaatatagtgacgttgataattaaggtttttattcccttgtctatgcaaccgactcactgacgtattatgcagataatatttatataatgattgctcggtatatcgcgcacgcagcgcgttaaacataaattctgttgtccagacaatatcctgatgatgtaatccggcaataaatttaatgttatttttaacaataacatcgcggcgataaacccccatccagaccacgtgtgtccaacggcgggaagaaagtcccatccgcagccagtccggaccagttaatacaccggttgagcgaaggcgatcggtagggatggattgccaggtttcacccgtttcacgaaaacaccaatcagcgttgcactgcgccacgtcgaggtcgtcctctaacgccatggtcatcagcgtttcgtacatggtgggatagacctcatcgtcagcatcgacaaaagcgacatattttcccgttgccacttcaatcccacgattacgcgccaccgatgcgccagaattcgcctgatgcaacaaacgaacgtgcggatagttttctgcgtaatgctttgctatttcaacagaattatccgttgaaccatcgttaataataatgatttccagagcagtccatgtttgcgtaattaaagattccatacaagtgcggaaatcatcgcccgcattatataacggaataataacactaagtttattggtgctgttcatcataaattaccgacgacctctgaagttatcctgacgttttacaggctttgtattaagaaactattaagcctgtgagatattatttttaccggtgagagagtcacgtcagggtagagagataatgagagcagctatataagagatcagcgcaattacgatatcttgattacactgacaggattttacatatttaacggattatcctcaggcaaaagggctggaataccagcccttgttcgtgttaatcccagctcagaataactttcccggactggcccgaacgcatagcgtcaaagcccttctggaaatcatcgatagagaaacgatgggtaatgatcggcgagagatcgaggccagactgaatcagcgccgccatcttgtaccaggtttcaaacatctcacgaccgtaaatacctttaatgaacaagcctttaaagattactttggtccagtcgatagacatatcggacggtggaatacccagcatcgcaatacgaccgccgtggttcatggtgtcgagcatggtacgaaacgctggcggcgcaccggacatttccagaccgacatcaaagccttcggtcatgcccagttctgtcatcacatcattaaggttttctttagcgacgttaaccgcacgggtgatacccattttgcgtgccagctcaaggcggtattcgttaacatcagtgatcaccacattgcgtgcaccaacgtgtttcgccaccgccgcagccataatacctatcggacctgcaccagagaccagcacatcctcgccaaccagatcgaacgacagcgcggtatgcacagcgttaccgaagggatcaaaaatggaagccaggtcgtcggagatattgtccgggattttgaaggcgttgaacgccggaatcaccagatactcggcgaagcagcccggacggttaacaccgacgccgatcgtgttgcggcacagatgggtacgaccgccacgacagttgcgacagtgaccgcaggtgatatggccttcgccagaaacgcgatcgccaatcttgaagcctttcacttcctgaccaatacctaccacttcaccgacatattcatggcccacgaccatcggcaccgggatggttttttgcgaccactcatcccagttatagatgtgaacgtcagtcccgcagatggctgttttacggattttaatcagcagatcgttatgcccgagttccggtacaggaacgtcggtcatccagatgccctcttccgctttcagtttggataacgctttcatctcacaccctcaggcgataacgcccagttgtttaccaatacgcgtgaatgcttctactgcacgcgtaatttgctcaggggtatgcgccgcagacatctgggtacgaatacgcgcctgacctttaggaacgaccggatagaagaaaccggtgacgtaaatgccctctttttgcagctcacgggcaaatttctgcgccactaccgcatcgccaagcatgacgggaataatggcgtgatcggctcccgccagggtaaagcccgccgccgacatttgctcacggaactgacgcgcgttcgcccacagacggtcacgcagctcgctacccgcttcgaccatctccagtactttgatggatgcggcgacaatcgctggtgccagcgagttggagaacaggtacggacgagaacgctggcgcagccactcaaccacttctttgcgccccgcggtataaccaccagaagccccgcccaacgctttacccaacgtaccggtaatgatgtctacacgccccatcacatcgcagtattcatgggaaccacgaccattttcaccgacaaaaccgaccgcgtgggagtcgtctaccatcaccagggcatcgtatttatctgccagatcgcaaacgcccttcaggttggcaatcacgccgtccatcgagaacacaccatcggtggcaatcagcacatgacgcgcaccggcttcacgcgcttctttcagacgtgcttccagctcctgcatatcgttgttggcataacgatagcgtttggctttacacagacgcacaccatcaataatagacgcgtggttcagtgcgtcggagataatggcgtcctccgcgctcagcagcgtttcaaacaggccgccgttagcatcaaagcaggaagagtagagaatcgcatcttccatccccaggaaggccgccagtttttgttcaagctctttatggctgtcctgagtgccgcaaataaaacgcaccgaagccatgccgaaaccgtgagaatccattcccgcctttgccgccgcaatcagatccggatgattcgccagtccgagatagttgttggcacaaaagttaatgacgtggcttccatcagccacagtgatatctgcttgctgcgcagacgtaataatgcgctcttctttaaacaacccttccgcccgtgcggtttccagatcgttggttaactgctgataaaattctccacgcattgcgattctccagacagggcaaattccagcacatattacccaaacttataggtcgcgacgagatgacgcgttaacacttctgcaaaattcaggataaataacgtccagccccctcacttttggtgaatggctgaagccaacgtcatgtagtgatatgatagaagtattcgtgtctgagattgtctctgactccataattcgaaggttacagttatgatcatcgttaccggcggcgcgggctttatcggaagcaacatcgttaaagccctgaatgataaaggcatcaccgatattctggtggtggacaacctgaaagacggcaccaagtttgtgaacctggtggatctggatatcgcggactatatggataaggaagacttcctgatccagattatggctggcgaagagttcggcgatgtcgaagcgattttccacgaaggcgcgtgctcttccaccaccgagtgggacggcaagtatatgatggataacaactatcaatactccaaagagctgctgcactactgtctggagcgcgaaatcccgttcctgtatgcctcttccgcagccacttacggtggacgcacctccgactttattgaatcccgcgaatatgaaaaaccgttgaatgtctacggttactcaaaattcctgtttgatgaatatgttcgccaaatcctgcctgaagcgaactcacagattgttggcttccgttatttcaacgtttatggaccgcgtgaaggccataaaggcagcatggcgagcgtcgctttccatctcaacacccagcttaataacggtgaatcaccgaagctgttcgaaggtagcgagaactttaaacgtgacttcgtctatgtgggcgacgtggcagatgtaaacctgtggttcctggaaaatggcgtttccggcatcttcaacctcggcaccggtcgtgcggaatccttccaggcagtagcagatgctacgcttgcttatcacaagaaaggccaaatcgaatacattccgttcccggataaactgaaaggccgctaccaggcgttcactcaggcagatctgacgaatctgcgcgcggcgggttacgataaaccgttcaaaaccgttgccgaaggcgtaacggaatacatggcctggctgaatcgtgacgcataagagctctgcatgaaaatactggtgatcggcccgtcttgggttggcgacatgatgatgtcgcaaagtctctatcgcacgctccaggcgcgctatccccaggcgataatcgacgtgatggcaccggcatggtgccgtccattattatcgcggatgccggaagttaacgaagcgatccctatgcctctcggtcacggagcgctggaaatcggcgaacgccgcaaactgggtcatagtctgcgtgaaaagcgctacgaccgcgcctacgtcttacctaactccttcaaatccgcattagtgcctttcttcgcaggtattcctcatcgcaccggctggcgcggcgagatgcgctacggtttactcaacgatgtacgcgtgctcgataaagaagcctggccgctaatggtggaacgctatgtcgcgctggcctatgacaaaggtattatgcgtaccgcacaagatctgccgcagccattgttatggccgcagttgcaggtgagcgaaggtgaaaaatcatatacctgtaatcaattttcgctttcatcagaacgtccgatgattggtttttgcccgggtgcggagtttggtccggcaaaacgctggccacactaccactatgcggagctggcaaagcagctgattgatgaaggttatcaggtggttctgtttggctcggcgaaagatcatgaggcgggcaatgagattcttgccgctttgaatacagagcagcaggcatggtgtcggaatctggcgggagaaacacagcttgatcaagcggttatcctgattgcagcctgtaaagccattgttactaacgattctggtctgatgcacgttgcggcggcgctcaatcgtccgctggttgccctgtatggaccaagcagcccggacttcacaccaccgctatcccataaagcacgcgtgatccgcctgattaccggctatcacaaagtgcgtaaaggtgacgctgcggagggttatcaccagagcttgatcgacattactccccagcgcgtactggaagaactcaacgcgctattgttacaagaggaagcctgacggatgcgggttctgatcgttaaaacatcgtcgatgggcgatgttctccacacgctgcccgcactcactgatgcccagcaggcaatcccagggattaagtttgactgggtggtggaagaagggttcgcacagattccttcctggcacgctgccgttgagcgagttattcctgtggcaatacgtcgctggcgtaaagcctggttctcggctcccataaaagctgaacgcaaagcgtttcgtgaagcgctacaagcaaagaactatgacgcagttatcgacgcccaggggctggtaaaaagcgcggcgctggtgacgcgtctggcgcatggcgtaaagcatggaatggactggcaaaccgctcgcgaaccgttagccagcctgttttacaatcgtaaacatcatattgcaaaacagcagcacgccgtagaacgcacccgcgaactgtttgccaaaagtctgggctatagcaaaccacaaacccagggcgattatgctatcgcacagcatttcctgacgaacctgcctacagatgctggcgaatatgccgtatttcttcatgcaacaacccgagatgataaacactggccggaagaacactggcgagaattgattggtttactggctgattcaggaatacggattaaacttccgtggggcgcgccgcatgaggaagaacgggcgaaacgactggcggaaggatttgcttatgttgaagtattgccgaagatgagtctggaaggcgttgcccgcgtactggccggggctaaatttgtagtgtcggtggatacggggttaagccatttaacggcggcactggatagacccaatatcacggtttatggacctaccgatccgggattaattggtgggtatgggaagaatcagatggtttgtagggctccggggaatgagttgtctcaattgacagcaaatgctgttaagcaattcattgaagaaaacgctgaaaaagctgccatgatttaaattacaactctttaatagataattttgaaataaaatcagcttccttgctgattttatttcacatattcattacttatctaataaacattggtccgattgtactttaaaataagcacaaagcaatattatggtgacaaacacagcagtcggaaccggtttagaaaagagtattacatcacttaggcctactaccagtagtgaaaaaagcaagattaaaatataaggttctttagcagttcttaaggcatatatgaatattgctgaaaaggctaaaattgttaatgctactccaggaataccacgcgttgataacgtatctatgagatcgttatgcaaatgagaatctacaaagggtaaagcaccacttaatctaggctctttctcttctagttcatgtattttttccgcacgtttttccagtgattgtcctattggagaatatgtttttaaaccaacttcatacattgccagacgggcaccgactgaagttctggtgttatcatgcgaataattaactaaatccctatttaagtcattcattctcgtaagtaatgtatctttaaaagaaaatacacctgctaataatgcaatcgcaataaaacaatataacttataattaattcgcttattaatataactatccattacgattaatagtaacgcaaagaatggaaacactaatatggctgcacgcgtttcagttactataacagcacataagctaagcatgaagttaattgtatataatgttgttttatgtctaaagtcggattttaaaatgagaattgatgccagtaaagaagggaaaaggatgatgtagcctgctgttgtagcgtgggaagctgataatgcaacacggtcgacgtttaaatagaaatgttgccacatggcatgcgcaaaaaaaagtaactgcgttgccaaggatgcgaacagaattagtttcccaaattttattttggttctcatctcatctttagcaaaaagaactaagaaaataaaagcactacacaaggcaatttttccagtttccattgggccacgatatgcattggtataaaccgagcctgaaactttataatgtgaataccagatgatattaacgatacccaaaagacataatgagatgaaaattaacaaagtaggattattagttattgttttttttggtgtcgctagaaaatataatgcagatataattccagctgcatgaagaaactttgttgcaacatcatcccacaaagacaaagtcattaaagacaacatacataatatgagaattaaagacttgacaccagagttaatttcattccaacaaaacgacatataatttcaacctatgctacgaggatgggttatttaatgcaagacctaacgtttattcttttttctatttaccagtcttaccatcctccagagaatatagttttttgatgctaatatctttgctcgcctcttatctctcttgccaagaagattacaatctttcaattctttttcattgctttcaactaattgatttaataattcaaaatcgccattaagtagaacattccataaataacgagttttatgataagttctatttttactcaataatgtatgaatttcttctttccggttacctttgtataactgcatcacagaagagtagattctttcgtgcgcaaatgactcatgtcgataatgagtgatggttctacatgagttcattaaggaattttctctatagttatgcttatacatataatatggaaccgcatacatatcgcatgtaattagcagtcgatagataaaatccagatcttctcctagtcgtaaatcttcatcaaaaaaaagattattatcttccaggagttgttttcttataaacaagcatcctatatggaatctgacctttttataaaaaaaatcgaaaagtaaagacccttcattaaaatctgtatttataggtgagtaagtaacaccattttttatatgatggccataaagcccacaataaatcgcatcccctcccgtctcatgttgtctggaatacatcttcagcagatagttaggatctatctcatcatcatcatccataaaacatataaactgtccttgcgccttgcggatacctgtattcctggcagacgaaacaccgccattttctttattgataataattaatcgagagtgggttaacccatactctctcaaaacacttgatgtgttatctttagaaccatcattaacaataacaatttcaaaatttgggtaagtttgtttttctaatttcgttagagtttcagtaatgtaatcagatgaattatacgtcggtattattatggatactaaagggtaatcattgctcatcgtgttctcttgcctgaactaataaaatattatagtactcatccttaattattattgtaactcagacatccatgattttttattattgcccaaatagttttcttttatacttatttaatttgaatttaatgaagtaaataaaagcgttaaacgtatcaccatttttctttgcatgttggtatttcacttgatactgcttttcattcgtggctggaataaacgccacatcattccagcaagaaacctgataagcctcattaaaatacttctggcaggataattcgtccagtcgttccasggcttcgttacgccaacataatgaatcagcttagtatcatcggtaatggtctttttataatcttcatcgcttttattttttaactcatagtcaatgccataaaagcaatcataatcgccgctaataaaaatacaatgactaaagaacagaatatttaaaatatcctgatcaaggcatttatatttcgtgtgctgcgggtcacttgccagcatagcaatggctttattcataaaatcatttttcgcccatgcttcaagctgcagatatactacaccggcgttgaaataattccctggaagtccctctatagccagacgcttcgcaggtttttcctgcataaaaggcacatctttaataacagccgcgaacttatcgccatcaaaattaatatcaagcaatccagctaatgagcctttacatatgacatcagcatcgatatataacagattttcaatagtttcactcagatactggaacgcaactaaacggaagaatgttgcataagaccactgtttcaggctggggaagatatcaataaaggcactggatactttataaattcttacttcaacgttagcatttttgctggtaaaagcattaacacgttgtagataatcttcatcaatgtagtcagtaaagagatgaaacttaaccgcaaggtccgggttatgcataacaactgattgcatagatactgccgcaccaaataaaaagttgcggtcaataccgtaagcgatatttaacacacgatcggtgttagcaatttccccagagacagcgacttcagtaatactctcagctaataaatccatgttggttccgttttgactgtgtggtttacgctttgccttttaattttttaataaatttgcgtagtttggttctgtagattactgaatagtagccataatcttttatttcgttggcaatacccaggtgacgttccatggccagacgatcacgggctttccgctctgccgtacagcttttaccggagaggtcaattatcctgacaccatctttactaacgataaagttaccccggtgtgggtcgcccgatagcatatttaaggcatgcaatttttccattgaagccttaatttctgctttaacatcttctggaataatcggcatatcattgagctctacgccctcgacatactcgataagcatgataaaaacactggcatagttgaaaattttacgctcagccagaaaataaaaatcattaggaaaagtaagacctgcacttctgacacgatcggtttcaacgatcaaattctgatagtagtcaccttttacaaaagattttaaaaaacgttcattccttttcgttttcggggcaaagactttaaaaacatagcgaccatatttcgtatcaatcaacgatactttggtatcatcaatattacgtaatacttttactgttttaaaattataggccagtatttcatcaaagatttctttatatttattatcgttatctttgtaataaaatgagaagccgcgatagcgtatacttgtaatcataagagtaatttatttcttaagcttgtacttaattaatgaagttatacctttaatatactcaccatgggcaaacagatgcttatattgtttctgcatttctgcaacagtccgcgcctctttaagaggatatttcttccagggagattgttcacgcgcgatattaaagtatgatgcagacggatatccagcccagctatgccatggtttagttatccctgtatagtgaatcaatactgttttatcggtaatggtttgctgatactttcgatgactacgatcatgaagttcgtttttcagggtataaatagtatcaaaatccttcgcgaggtagatattattcatattaaatgcgatattcaacgcatcctgatctaaatatttaagagagccatatttagtttcccctcgtaaaagcgtgagtaaatacggtgtcaaatttgcttcatgccattttttaagattgacatagataacgcctgcattgaaataacgtccattcatttcgggaatgttaagacgttttgcacatgccgcctgagtactatcattgtcaggaataaccgcagcaaactcatctttaaatataatttttgtgagaggtttcagacttcctttacaaacgacatcggcatccagatacagcagtgtggaaatactttcactcagatattcaaaggacaataccctgaagtatgtcgcgtacgaccaaaactgtgacgtcggcagatcagcaaagtattttgggtcaattaaatatacaataattgaggtattaaattgttttgctgtttcattaaatgactttaaataatcatcatccacataatcagtgaaaacatgaaagacaaaattaatatctgaattattaatcaaaacggaagaaattgaaacgccagcaccatacaaaaaattcttatcgataccgtaggaaacatttagctctggggcgttttcttttttattatctgctaaatacgaaaaccgttcttttataaattcattcatttaacttttctcaatatcattttattatctttaaataaaaataataaatataattcattatcccgttaattggtttgttttgtttaaaattatgcttagcgcaataacgagcataatttgagttaactggccgcattaacggttcatttttccagggcgatgcttctttggctttgataaaaggttgcgcacttggataaccggcccagtaatgccagggttttgtcgggccgacataatgaattaatacggtttcatcattaattggacaaacaaatgatttttttaattcataatttaaactaaattgcgtattgtatttagcatcaatgaatttaactttccctaacaggataagattaaggatatcttgatccatataggttaaacgggaaacgatggctttatcagcaagcatcgacatcgctttagcagaaacggactcctgcgcccacgctagtgtattaattaacaggacacctgaattaaagtaacccttttcaagttcattacactgcagactttgaccccgtaacgaccaccagttagcatcgcgttcagtaacaacagcagcaacgttattggcaagatccattgttatcagcggctttaagtttccctgacaggcgatatcagcatccaggtacaggatcttatcttgttgatcaataaagtaatctgcaattacaaaacggaaatacatggcaatagaccaatttttggtcgtcggtaatgccttaagccgttcacaattcaccagatggatctggatacaggtatgatagcttttcgctaattgggataaacgctggatatcggcttcagggatatcatcaataaaaacgtggaagacaaaactcacgtcgttgttatgtaacaaaactgacgtgattgaaacaccacaaccaaaaagaaagttctgatcaatgccataagcaacatggaatgatgatgccactgacgcctctgggctttcatcgaagatgattgtcttattgatcatctcttgtggattaaaatagtgggcactcatatttctctccggaaattacaacgattttcgaatcgttctttccctgatttttgtggctttttcttctgcttgcgacagcagcccttgttcctgcttgataatgtctttaagcggggcgacaaaatacactttcataaaccgccagatatcccgctgagtcaggccaatattcatcgaagaaaaataaagtccaataagatctttatcccgccaacgacgcggtacttttgcacgtatctgcgcccggtgcaggtcaattactgaaatttttaacacctcttccttaccggaaaaaggcaagtgcagcaggaaatgacagatataacagtcacggtggttaatgcccgcagcatgcatatcgcgcaccatcgtcgcgacacgcttaataagcatacgctttacgcgaacatctggtgggttggtcgcccagtcagcacagtaatcttccagactgatggttggtgtcagatcttcggtaataataaacgaggttctggtcagcggattaatgcctttttcgccgaatgccaccccatacatagtatcaacgccgacatcccgcagtcgatgaatcgcattccattcgcggtctgcgcctaatactggcatccgcaatgagagtaaatttttgattatctctttcagggtcgtgccgcgatgccatttgagaaaatagcttttgcccgccatttcaaagcgcagagtgcggcgagtttccagttcacgaaatacctcaccctgcaaggttttaacttcctcaaaaggatctttaccgcgccataacgtggcaaacggctctttaagttcaaccatccagaccacccgttatgatgtccgccgctttctctggcagactgtataaatcttgtgtatcagcataatgtcgcgcattttccgcccatgcctggcgcaatgaagattgcgttaacgctttgcgtaaaatctcattcaatgtttcctggcggaatggctcagcaatagcctcgccgcaattggcgtcgacaatataatgcgcatagccacaaacggctgttgttagtaccggtaatcctgcagttatcgcttccagcagtacaattcccgcggcttcctggtaggcaggatgaagtaataaatccgccgctgccattaattccgagacatcgttgcgccccgagaagaagtgaacattactgcgcacgccgcgtttttctgccagcgcctcaaattttcgcggtttatcctgcccaacaacatatagtaatgtgttgtggcgcagcgaatccggtaacgaagcaagtgcttcaatggaacgatcgacacctttacgcgtgaagtctgaaccaacctgcaacaataaatattgttgttcggttattccattcttcttacggaagatttcacggctattggctggctgctggctatatttacgatcaggataaatccccggaggcagaatatgaaaacgctccgcttcagtctgataatgtttctggaaatcggcgatttgcttatctgtcagcatcagcagctgtgtcggcttgccctgttcgaaggttgcccgctcaaaggcggcataatggcgataacgtgacgtcaggcgatagaaaaagcctttttcctgcgctactttctcggcatagcaaacatcagcggcataataaacgtccagccccggcattttgttgaatccaacgactttatcgacgggatgttcgcgtaaatgtttttgcacccaggcaaaatactccgcattgcgcccgtgattggtatgcgatttaaccggcactttgatcagttcaaatacatcagggcattcgccttcccacgactgggtataaacccgaacatgatgacctcgggcggcgactgtctgagcaatacgcataaaatcgcgctgcaaaccgccaaagggaaaatatttatataaacaaaaagcaacgatcataacgacgtacctgtcgtggaggagggcagtaatttatcgacagcagcaatgacatctgccgccggaataaccgaaagatacatctcatttcggtcacgctgatcgcgcgttggcatttcccggtaatctcccgcccagaattgaatcatgttatttgaccagggacgccagaaaatatggtctgtcgcaccaaacagcgatatcagcggcgtattaactgcagcggcaatatgcgccggtgcggaatcaacgccaataaacagctgggcatgatcgattaacgcaccaagttccgggaaggtcacctttccggccagcgccgttactggtagcgtctggcatccctgggcaatttcattgacgcaggccagatcgtctttatctgggccggacgtcagaacgacttcataaccacgagcatgtaaggcatcaatcacagcggaaaacttggcgttgtcccagcatttgaagatttgccgcgccgtaggttggataaccacataattttgtccaacacctgcatgatcaagttcgcgacgcatacgtttccagcttgcaggcgggtaactcatggttgtctgcttcaccaacgattcaagtcccaatggcgtcagcacggataagttactttccaccacatttccaccctgcaacggcaccaaatgagtgaaactattacgccaaaaagcagactgccgatgatgataatcctgggaaattttcacacgggcatttaataaacgaaccagtatagcaatcatccattgatcggtaagattaacgataaggtcatacttattggcacgtaataccttgatgagatgaaaaaagttggcaattttttctgaggcttttgcttttttattttttatgccgtagagcgcgttaatctctggattttcagacaggatcgggatggtgtcctgataaagcagcacatcgatttttgcgtcagggtaattttttttcagcgaactaatgacgggagtagttaataacatatccccatgaaaacgcatcttaatgagcaaaattcttcgaaatggcttatccacaagtaactctttttgttgagattatccgattaaggtgaagcagaaaaagcacgctaccgccccaggctcaacagctacctgaatactgataccgcactgatattgacgcgctagtgtatcacttctttcgcggcaatccgactcgaatgatttttaagcacattgttgattttcaataaagaaatcaatcaaataaaatcattagcaaccatattcttttactgttgctctgcgattccttcctgcacgtactgcagaaatcaatgaatcgcataaaaatacaaaaaaagtatagatgttcagcaagaattggcgggtaaattgctatttaagtcaaaaacgggaaaagtaatggtaaagccacagctaaatacatagaatccccagcacatccataagtcagctatttactatgctcgaattgctttacaccgcccttttctaccttattcagccgctgatctggatacggctctgggtgcgcggacgtaaggctccggcctatcgaaaacgctggggtgaacgttacggtttttaccgccatccgctaaaaccaggcggcattatgctgcactccgtctccgtcggtgaaactctggcggcgatcccgttggtgcgcgcactgcgtcatcgttatcctgatttaccgattaccgtaacaaccatgactccaaccggttcggagcgcgtacaatcggctttcgggaaggatgttcagcacgtttatctgccgtatgacctgcccgatgcactcaaccgtttcctgaataaagtcgaccctaaactggtgttgattatggaaaccgaactatggcctaacctgattgcggcgctacataaacgtaaaattccgctggtgatcgctaacgcgcgactctctgcccgctcggccgcaggttatgccaaactgggtaaattcgtccgccgcttgctgcgtcgtattacgctgattgccgcccaaaatgaagaagatggtgcacgttttgtggcgctgggcgcaaaaaataatcaggtgaccgttaccggtagcctgaaattcgatatttctgtaacgccgcagttggctgctaaagccgtgacgctgcgccgccagtgggcaccacaccgcccggtatggattgccaccagcactcatgaaggcgaagagagtgtggtgatcgccgcacatcaggcattgttacagcaattcccgaatttattgctcatcttggtaccccgtcatccagaacgcttcccggatgcgattaaccttgtccgccaggctggactaagctatatcacacgatcttcaggggaagtcccctccaccagcacgcaggttgtggttggcgatacgatgggcgagttgatgttactgtacggcattgccgatctcgcctttgttggcggttcactggttgaacgtggtgggcataatccgctggaagcggccgcacacgctattccggtattgatggggccgcatacgtttaactttaaagacatttgcgcgcggctggagcaggcaagcgggctgattaccgttaccgatgccactacgcttgcaaaagaggtttcctctttactcaccgacgccgattaccgtagtttctatggccgtcatgccgttgaagtgctgtatcaaaaccagggcgcgctacagcgtctgcttcaactgctggaaccttacctgccaccgaaaacgcattgaggttgttatgcaaaaacgggcgatttatccgggtactttcgatcccattaccaatggtcatatcgatatcgtgacgcgcgccacgcagatgttcgatcacgttattctggcgattgccgctagtcccagtaaaaaaccgatgtttacccttgaagagcgtgtggaactggcacagcaggcaaccgcacatctggggaacgtggaagtggtcgggtttagtgatttgatggcgaacttcgcccgtaatcaacacgctacggtgctgattcgtggcctgcgtgcggtggcggattttgaatatgaaatgcagctggcgcatatgaatcgccacttaatgccggagctggaaagtgtgtttctgatgccgtcgaaagagtggtcgtttatctcttcatcgttggtgaaagaggtggcgcgccatcagggcgatgtcacccatttcctgccggagaatgtccatcaggcgctgatggcgaagttagcgtagagtttatgccggatggtatgccatccggcgcgcatcaattacttctggcactgccgacaataaaacgttgcccgctgcgcatgtttagtcgccacaatcggcgtaccgcacacccgacacggctcaccttttcgcccgtaaacctgcaattcctgagcgaaatagcccggtttaccatcactttgcagaaaatctttcagcgttgtaccgccctgctcaatcgaacgcagcaacaccgctttaatcacccgagctaacaattcacactccgccagcgacagtgatgacgccagccgatccggatggatccccgccgcaaacagcgattcgctggcatagatattccctacgcctaccaccagcttgttatccatcagccacggtttaatcgccgtttttttcttcgcgcacttctgatgcaggtactcaccgttgaaatcgtcactaagcggctccggtccaagatgggccagcacgttgtgcccttccagctctttggtccatagccaggcaccaaagcggcgcggatcggtgtagcgcagcactttgccgttgctcatcaccaaatccacatggtcatgcttttcagggggaagttcttctggaaggatgcgcaggctgccagacatccccaaatgaatgataatccagccctcaggcagctccagcagcagatatttagcccggcgctgcacgctaagcactggttggtcgcttaaacggtagatctcttctgaaaccggccagcgcaagcgtccgttgcgcaccaccgcatgaagaatggttgcaccaacgagatgcggttctatgccgcgacggctggtttcaacttcgggtaattcaggcatagcatctccaggaatgaacagatgcagtcaatatgggggcaagcagataacaaaaaaccccgccggggcgaggttttttgttacatcaaagcgagaattatttgattttcgcttctttgtagatcacgtgctggcgaacaactggatcgaattttttcagttccagtttttccggcttagtacgtttgttcttcgtagtggtatagaagtgaccagtaccagcagaagaaaccagcttgattttctcacgaatacctttagccatgatttatttcctctaagtacttagtacttttcgccacgggcacgcagttcagccagaactgtatcgatgccttttttatcgattacacgcatacctttagcagatacgcgcagggtgacaaaacgcttctcgctctcaacccagaaacggtgagagtgcagattcggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtattggcgcctcgtcaggctttacagcccggtcatcgcagttctatgtgaactctcgattgccaggcccaaatgccaaacccgagattctcaaaggtggcgtagtatacgctgactcagcgatgtgctcaagtcccgaacagacaaagatcccgaaggatcgcgcatagcgggttaaatccagccgcgttcggcaaaagaaacatactctccacgcccaatcacgatatggtcgagcacgcgtaaatccatgaactgacaactctttattatccgttcagtaatgagtttatccgctttactgggttcagcacaacccgaagggtgattatgcgcaaggatcagcgccgaggcgtttatttttatcgcttcgcggataatttcccgaggatggacttcaacatggtttagcgtgccggaaaaaagacggctatgcgttataacccggtgttgggagtcgagaaagatcaccataaagatctcccgctcctcgcccgtgagctggctttgtaaaaattccctcgtcatctccgggctgagtaaagggctttcttcacgcatccgtacgttgtagtaacgccgcgccagttcggcaatcccctttaactgggcgaatttcgccacgccaattccatgaacgccactaaattgctcatattcagaggttaacaagccataaagagagccgaaattctccagcatctcttttgccagggttaatacatctttaccgcgcgttccggtacgcagaaatagcgccaacagctcgacatccgttaaggcgctaataccaaacttcagcattttttcgcgcggcatcaacagctgtgcattgtttttcaccttcacctcctttgtggtgctcgcatcctgtcatagccgttcctttaaatcgacggccagttttcaatcctggaaagcgcctcgcaaagtgaatctcaggtgaaggcacgacaacaaaagtattgtgataaaatcgccaacttctggtgtcacccaacaggaaaaatcatcatgagcctggccggtaaaaaaatcgttctcggcgttagcggcggtattgctgcctataaaacccctgaactggtgcgtcgtttgcgcgatcgcggggccgatgtccgcgtagccatgaccgaagcggcaaaagcctttatcaccccacttagcttgcaggcggtttctggttatcccgtttccgacagtctgctggacccggcagccgaagccgctatgggccatattgagctgggaaaatgggctgatttagtgattctcgcccctgccacggcagatttaattgcccgtgttgcagccggaatggcgaatgacctggtatcgacgatttgtctggctacacctgcgcctgtagccgtgctccccgccatgaaccagcagatgtaccgtgccgccgccacccagcataatttagaggtgcttgcctcgcgtggtttgctcatctgggggccagacagcggcagtcaggcttgtggtgatatcggcccagggcgaatgctcgatccgttaaccattgtggatatggcggtagcgcatttttcgcccgtcaacgacctgaaacatctgaacattatgattaccgccggtccgacgcgtgaaccgctcgatcccgtgcgttatatctctaatcacagctccggcaagatgggttttgctatcgccgccgccgcagcccgtcgtggtgcgaacgtcacgctggtatcaggtccggtttcattaccgacgccaccgtttgttaaccgtgttgatgtgatgaccgcgctggaaatggaagccgccgtgaatgcttcagtacagcagcaaaatatttttatcggttgcgccgccgtggcggattatcgcgcagctaccgtggccccagaaaaaatcaaaaagcaggccacgcagggtgatgaattaacaataaaaatggttaaaaaccccgatatcgtcgcaggcgttgccgcactaaaagaccatcgaccctacgtcgttggatttgccgccgaaacaaataatgtggaagaatacgcccggcaaaaacgtatccgtaaaaaccttgatctgatctgcgcgaacgatgtttcccagccaactcaaggatttaacagcgacaacaacgcattacaccttttctggcaggacggagataaagtcttaccgcttgagcgcaaagagctccttggccaattattactcgacgagatcgtgacccgttatgatgaaaaaaatcgacgttaagattctggacccgcgcgttgggaaggaatttccgctcccgacttatgccacctctggctctgccggacttgacctgcgtgcctgtctcgacgacgccgtagaactggctccgggtgacactacgctggttccgaccgggctggcgattcatattgccgatccttcactggcggcaatgatgctgccgcgctccggattgggacataagcacggtatcgtgcttggtaacctggtaggattgatcgattctgactatcagggccagttgatgatttccgtgtggaaccgtggtcaggacaacttcaccattcaacctggcgaacgcatcgcccagatgatttttgttccggtagtacaggctgaatttaatctggtggaagatttcgacgccaccgaccgcggtgaaggcggctttggtcactctggtcgtcagtaacacatacgcatccgaataacgtcataacatagccgcaaacatttcgtttgcggtcatagcgtgggtgccgcctggcaagtgcttattttcaggggtattttgtaacatggcagaaaaacaaactgcgaaaaggaaccgtcgcgaggaaatacttcagtctctggcgctgatgctggaatccagcgatggaagccaacgtatcacgacggcaaaactggccgcctctgtcggcgtttccgaagcggcactgtatcgccacttccccagtaagacccgcatgttcgatagcctgattgagtttatcgaagatagcctgattactcgcatcaatctgattctgaaagatgagaaggacaccacagcgcgcctgcgtctgattgtgttgctgcttctcggttttggtgagcgtaatcctggcctgacccgcatcctcactggtcatgcactaatgtttgaacaggatcgcctgcaagggcgcatcaaccagctattcgagcgtattgaagcgcagttgcgtcaggtattgcgtgaaaagagaatgcgtgagggcgaaggctacgcgacggatgaaaccctgctggcaagccagatcctggccttctgtgaaggtatgctgtcacgctttgtccgcagcgagtttaaataccgcccgacggatgactttgacgcccgctggccgctaattgctgcacagttgcagtaatatgacgccggatgacttttcatccggcgagtttctttaaacgccgaactcttcgcgataggccttaaccgccgccagatgttccgccatttctggcttctcttccagataggcaatcagatctttcaaggtgatgatagagatcactttgcagttgtaatcacgctcaacttcctgaattgccgaaatctcgccgcgcccccgttcctgacgatcgagcgaaatcaatacgccagcaagcgtcgcgccattggcctgaataatttccatcgactcgcgaatcgccgttccggcggtgatcacatcatccaccagcattatgcgtccttgtaacgcgctaccgaccagattgccgccttcaccgtggtcttttgcttctttgcggttaaagcagtacggcaggtccaggtcatgatgctccgccagcgccacggcagttgtggtggcaatcgggatccctttgtaagcagggccaaacagcagatcgaactcaatgccggaatccaccaatgcttcagcgtaaaaacggcctaacagtgccagatcgcgcccggtattaaacagcccggcgttgaagaaataggggcttttgcgcccggatttcagcgtgaactcgccaaactttaacacctgcttgctaagcgcaaattcaataaactggcgctgatatggtttcatgccttcgctcctcatcttacttttctacagacaaaaaaaaggcgactcatcagtcgccttaaaaatcagtttgccagcgccgccttctgcgtcgctacaatggattcgattccccctcgggccagcgccaacaaggtgagtaactcttcgtgggtgaacggttcgccttctgccgtcccctgcacttcaatgatacgcccgtcttcggtcatcactacgttcatgtcggtctctgcggcagagtcttcaacatattccagatcgcaaaccgcttcgccgttcacaatcccgacagagaccgcggctaccatccctttcattggattagttttcagcttgccgttttccaccagcttctgtagcgcatctgccagcgccacgcaggcacccgtaatcgaagcggtacgcgtgccaccatcagcctgaagcacgtcgcagtccagcgtaatggtgaactcacccagtgctttcaaatctactgccgcgcgaagagcacgggcgatcagacgctggatttccattgtgcgtccaccctgcttacctttcgccgcttcacgcgcgttacgggtatgggtagaacgcggcagcataccgtactctgcggtgatccagccctggccctgacctttcaggaagcgcggcacgccttcttcaatagaggcggtacacaacactttggtatcgccaaattcgaccagcaccgagccttctgcatgttttgtatagttacgagtcagggtaacgggacgcacctgattattgctacggcctgctggacgcatattgaaatctccggcttgaaacaaatgtggctgcgcattatacggacttccggcggttattcctatcctgacaaggcatcgatggctataatccttccacctctccttttataaacaggaacgtctatgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtaccctgcgctatgagccagatgttagcgcgcaaggtgagctgatcctcaacgaaaaactggctaaacagctggtaactgccgcgaactgggtaaaaatgcagagcgacgaaggagaaatcaacccggttgatattctacgctggccgggcgtgatggcagcccaggagcaagatctcgacgcgattgcagctgaaattctcgcggcgttggatggcaccctggatgactttatcatcgcgcgcgaaaccgaaggtcaggcgctgaaagtgttgattgagcagcgtctggaaggcgtcaccgccgaagtggtcaaagtccgcgcccatatgccggaaatcctgcaatggcagcgtgagcgtctggtagcgaagctggaagatgctcaggtgcaactggaaaacaaccgtctggagcaggagttggttctgctggcacaacgaattgacgttgccgaagaactggaccgcctcgaagcgcatgtcaaagagacctacaacattctgaagaaaaaagaagcggttggccgtcgtctggactttatgatgcaggagttcaaccgcgagtcgaacactcttgcttcgaaatctatcaatgccgaagtgacgaattctgccatcgagctgaaagtgttgattgagcagatgcgcgagcagatccagaacattgaataactcgtaacgccaattcttccttttcagccttcacaaatgccgcccactcaaacagagcggcatttttcctccccgcaacattcaattctgttttgcgtgcctgctccagattttgcgatgtttttttgcccagcgcagtgagaacgtgagatactcacaactgtatataaacacagttgtaaacttactttccttgcaatcgatatcatatggagtgggcaatgaacgaacatcatcaaccttttgaagaaatacggcattatggcactgaagggcaagaattttggtcagcgagagaattggcaccgttactggattatcgggactggcgcaattttcaaaaggtactggcccgcgcgactcaagcgtgcgaagccagcaatcaagctgcatctgaccatttcgttgaaaccaccaaaatggttgtattaggttcaggggctcaacgagaacttgaagatgttcatctctcccgctatgcctgttacctggtagtacaaaacggcgaccctgcgaaaccggttattgcggcagggcaaacttattttgctatccagacccgacggcaggagctggctgacgatgaagctttcaggcaacttcgtgaagacgaaaagcgtctttttctgagaaatgagttgaaagaacataacaaacaattagttgaggcagcgcagcaagctggggtagcgacagctatcgatttcgccatatttcagaatcatggttaccggggactgtatggtggattagatcagaaagccatccatcagcggaaggggctgaaaaagagtcagaagatcctggatcatatgggttcaacagaactggcggctaatctctttcgagctacccaaacagaagaaaaactcaagcgggatggcgtgaattcaaaacagcaagctaataccacacactttgacgtgggtcgcaaggtgaggcaaaccattcaggaacttggcggaaccatgcctgaggagttgccgaccccgcaggtcagcatcaagcagttggaaaacagtgtaaaaattacagagaagaaatagcagaaaataaaaactctttttgttgattgagatacccgatgcgtaagccaaagtccaggtgcggtgaacacaatggctaaacattgcacctttcttttccacccctcaattttaacctattttttcttatgcattttctcagacaagaagtcagaagaatgcatctacgctacagaaaatagcgatttcacataactacaagttatcaatttcctctcaccttaaaaaatctcaatcgtgacaatacgcacaaatcgctaccctgccagacagatttttagggagagaaccatgctgttacacattttgtatttggttggcattactgccgaagccatgacgggggcgctggcggccggacgacggcgcatggatacatttggcgtaattattattgcgaccgccacggcaattggcggagggtcagtgcgcgatattctgctgggccactatccgctcggctgggtcaaacacccggaatatgtgattatcgtcgctaccgccgcagtactcaccactatcgttgctcctgtaatgccttatctgcgcaaagtgtttctggtgctcgatgcgctcggactggtggtcttttctatcatcggcgcacaggttgcactggatatggggcacggcccaattattgccgttgtcgcggcggtaaccaccggcgtgtttggcggcgttttgcgcgatatgttctgtaaacgcattccactggtattccagaaagagttgtatgccggtgtctcatttgcctccgccgtgctgtacatcgcgctgcaacactatgtttctaaccatgatgttgtgattatctccaccctggtattcggcttttttgcccgtttactggcgctacgtcttaagctgggattaccggtcttttactacagccacgaaggtcactaaggttcaaaacctgtgatctgctgggcagccagccaactgcccagcttcttgatttgcgcattttccttccattcaataacctgtctggcgcgccccgatccagtccccggctgctgctgccagaactgttccgtgctaaataaaagttgcgaccaggaccgttcatcactggcattaagcgccgcccgggttagcggtattcccattgccatcacccagcgagtaaaaggctgctgacgagccagattaaactgatgccataactgcgcacttttacttttcgcgatccccggcgtgttctgtaattgctctggcgttaataaaagccaggaaaagatatgctcaaagcgatgagtctgatgcagggcgcgccagccggcctcaccaatgccatcaagccccagaacctgttttgaccccagccagactaagcgtgaaatgaactgttcctgacaaacatcagaagcaaagtagcaggtcaacgagttaaagcggttttctggtggtgtcggttttgtacgttctgctccgcgccagaccacatcatcaatgcgaggaatcccctgaccggcaaggctgacgaggatctgatcaccaggcgcaatatcccactcctgccagcgcctgacggaaccaatattcacccgctggacttttttatcatccagcatgacaggtgcgagtgacgccaccaccgatattttaccgctcttacccaccgcaaactgaatcgccttcacttcggcaacctgagctacaggttgatatttccaggccaccagccactccgcctggcccggtaaccaatgacgggattcgggttctttcgccgctcgcacaaccacgccatcggtgacgaagggtaattttgctttccaccactcattgcgtacgtgcgcaacctcatcagcatttttaaccgcgcgggtatacgtctgcgttaaagtaaaacctgcggtagccagatcctttaaacgatcggtcattaaatgcggtccatccggccatgcccagacaaaaacagccagtgagtttagcgtatcgctattcccctggcgcatcatcaggccagcaacttttgcgcgggcatttattccccccatttgttgttggatatgcccctcgcgctggagaaatatttccccctgaagcgtgctgttggctaaaggcccgctaacggtttgcggcacagcggaaattaagcgaactttctgcgtccagtcctcgcctttcaggccattaccgcgactgattgctttgttcagtttcccgtcccgataaaccagggttaccgcaacgccatcaacttttggctgcacccaaagatcgctacgttcgcgcatccacagacttaatgcgtttttatccgccattttgcgtacacccgtatgggcaaccggatgcataaccgcaccgtttaaaggcggcatcatcacatcgcgagtctcgttcccaaaacagcgttgccactgcgtgagacgggcgcttaactgatcgtaaacaccgtcttccacctcacttttcccttccttccagtagtcatcgtcccactgttttatttgctgttgcaggcgggaaatttcttcctgtgctctggctggcgaccaggccggacagaccgcccacgccgatgattgccagcacaagatacttattaatatcgccatccatactttcatcatcacctccgctgtagatagtcaggcagatatacaacgtggtgaaagcaaagccgagtggcaaaaacggagtctgcgaggacgcttcctgagaatcgtctttattgcagtgaatcacaggcaaatgcggaagcagctacgcaaaatgcaacaactttgcgcaaaaagtgtgagcaagggctacgtcacatggccgcgccgtgtataataagctcgtatgtaggctttatttcgctaatcacatacgaaagatactcatggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagtagagatgcgttcctcgaacacgcagaagtttttggtaattactatggcacttcgcgtgaggccattgagcaagtactggcgaccggtgtcgatgtttttctcgatatcgactggcagggtgcgcagcaaattcgccagaagatgccgcacgcgcggagtatctttattttaccgccgtctaaaatcgaactggaccgccgtctacgcggtcgcggtcaggacagcgaagaggtcattgcaaagcgtatggcgcaagctgttgcagaaatgagccattacgccgaatatgattacctgattgtgaatgatgacttcgataccgcgttgaccgatttgaagaccattattcgcgccgaacgtctgcgcatgagccgccaaaagcagcgtcatgacgctttaatcagcaaattgttggcagactgaacctgatttcagtatcatgcccagtcatttcttcacctgtggagctttttaagtatggcacgcgtaactgttcaggacgctgtagagaaaattggtaaccgttttgacctggtactggtcgccgcgcgtcgcgctcgtcagatgcaggtaggcggaaaggatccgctggtaccggaagaaaacgataaaaccactgtaatcgcgctgcgcgaaatcgaagaaggtctgatcaacaaccagatcctcgacgttcgcgaacgccaggaacagcaagagcaggaagccgctgaattacaagccgttaccgctattgctgaaggtcgtcgttaatcacaaagcgggtcgcccttgtatctgtttgaaagcctgaatcagctgattcaaaactacctgccggaagaccaaatcaagcgtctgcggcaggcgtatctcgttgcacgtgatgctcacgaggggcaaacacgttcaagcggtgaaccctatatcacgcacccggtggcggttgcctgcattctggccgagatgaaactcgactatgaaacgctgatggcggcgctgctgcatgatgtgattgaagatacacccgccacctaccaggacatggaacagctttttggtaaaagcgtcgccgagctggtagagggggtgtcgaaacttgataaactcaagttccgcgataagaaagaggcgcaggccgaaaactttcgcaagatgattatggcgatggtgcaggatatccgcgtcattctcatcaaacttgccgaccgtacccacaacatgcgcacgctgggctcacttcgcccggacaaacgtcgccgcatcgcccgtgaaactctcgaaatatacagcccgctggcgcaccgtttaggtatccaccacattaaaaccgaactcgaggagctgggttttgaggcgctgtatcccaaccgttatcgcgtaatcaaagaagtggtgaaagccgcgcgcggcaaccgtaaagagatgatccagaagattctttctgaaatcgaagggcgtttgcaggaagcgggaataccgtgccgcgtcagtggtcgcgaaaaacatctttattcgatttactgcaaaatggtgctcaaagagcagcgttttcactcaatcatggacatctacgctttccgcgtgatcgtcaatgattctgacacctgttatcgcgtgctgggccagatgcacagcctgtacaagccgcgtccgggccgcgtgaaagactatatcgccattccaaaagcgaacggctatcagtctttgcacacctcgatgattggcccgcacggcgtgccggttgaggtccagatccgtaccgaagatatggatcagatggcggagatgggtgttgccgcgcactgggcttataaagagcacggcgaaaccagcactaccgcgcaaatacgcgcccagcgctggatgcaaagcctgctggagctgcaacagagtgccggtagctcgtttgaatttatcgagagcgttaaatccgatctcttcccggatgagatttacgttttcacaccagaagggcgcattgtcgaactgcctgccggtgcaacgcccgtcgacttcgcttatgcggtgcataccgatatcggccatgcctgcgtgggcgcacgcgtcgaccgccagccttacccgctgtctcagccgcttactagcggtcaaaccgttgaaatcattaccgcaccgggtgctcgcccgaatgccgcgtggctgaactttgtcgtcagctcgaaagcgcgcgccaaaattcgtcagttgctgaaaaacctcaagcgtgatgattctgtaagcctgggccgtcgtctgctcaaccatgcgttgggtggtagccgtaagctcaatgaaatcccgcaggaaaatattcagcgcgagctggaccgcatgaagctggcaacgcttgacgatctgctggcagaaatcggccttggtaacgcaatgagcgtggtggtcgcgaaaaatctgcaacatggggacgcctccattccaccggcaacccaaagtcacggacatctgcccattaaaggtgccgatggcgtgctgatcacctttgcgaaatgctgccgcccaattcctggcgacccgattatcgcccacgtcagccccggtaaaggtctggtgatccaccatgaatcctgccgtaacatccgtggctaccagaaagagccagagaagtttatggctgttgaatgggataaagagacggcgcaggaattcatcaccgaaatcaaggtggagatgttcaatcatcagggcgcgctggcaaacctgacggcggcaattaacaccacgacctcgaatattcaaagtttgaatacggaagagaaagatggtcgcgtctatagcgcctttattcgtctgaccgcccgtgaccgtgtgcatctggcgaatatcatgcgcaaaatccgcgtgatgccagacgtgattaaagtcacccgaaaccgaaattaatgttttatgaacccaacacgttatgcacgcatctgcgaaatgctcgccaggcggcagcctgatctgaccgtctgcatggagcaggtccacaaacctcataacgtttctgcgattattcgtaccgcagatgccgttggcgtacatgaagttcatgctgtctggcctggcagccggatgcgcaccatggcttcggcagctgcgggtagtaacagctgggtacaggtgaaaacgcaccgcaccattggcgatgccgtcgctcatctgaaaggccagggcatgcagattctggcaacccatctttctgataacgctgttgatttccgcgaaattgattacactcgcccgacctgtattttgatgggacaggagaaaacgggcatcacgcaggaagcgttggccctggcggatcaggatatcatcattccgatgatcggcatggtgcagtcgctgaatgtttccgttgcctcagccctcattctttacgaagcccagcgccagcggcaaaatgcgggcatgtacctgcgtgaaaacagcatgttgccggaagccgagcaacaacgcctgctgtttgaaggcggctatccggtgctggcgaaagtcgcaaaacgcaaaggtctgccctacccccacgttaatcagcaaggcgagattgaagccgatgctgactggtggtccaccatgcaggccgcagggtaagcgcgatgaaaggtcgcctgttagatgctgtcccgctcagttccctaacgggcgttggcgcagcgcttagtaacaagctggcgaaaatcaacctgcataccgtacaggatttgctcttacaccttcctctgcgctacgaagatcgcacacatctctaccccatcggtgaactactgccgggtgtttatgccacggtggaaggcgaagtgctgaactgcaatatctccttcggcggtcggcggatgatgacctgccagatcagcgacggttccggcattctcactatgcgctttttcaacttcaatgcggcaatgaaaaatagcctggcgacaggccgccgcgtgctggcctatggcgaagcaaagcgcggcaaatatggtgcggagatgatccacccggaataccgcgtacagggcgatctcagcacgccagagttacaggaaacgctcacgccggtttacccaactacggaaggcgtaaagcaggctacgctgcgtaaattaaccgaccaggcgctggatctgctcgacacatgcgccattgaagaactcctgccgccggaactgtcacaaggaatgatgacgctaccggaagcgttgcgcactttgcaccgcccgccgccgacgctacagcttagcgatctcgaaaccgggcagcatccggcacaacgccggctgattctggaagagttgctggcgcacaacctcagcatgttggcgttacgtgccggtgcacaacgttttcatgctcagccgctgagcgccaatgacgcgctgaaaaataaactcctcgccgccttaccgttcaagccaacgggcgcacaggcacgcgtagtggcggagatcgagcgcgatatggcgctggatgtgccgatgatgcgtctggtgcagggcgatgtaggttccggtaaaacgctggtcgctgccctcgccgcgttgcgtgcggttgcccacggcaaacaggtggccctgatggcaccaaccgaattactcgccgagcagcacgccaataactttcgtaactggtttgcaccgctcggtatcgaagtaggctggctcgccggaaaacagaaaggtaaagcacgactggctcagcaagaagccatcgccagcggtcaggtgcagatgattgttggtacgcacgccattttccaggaacaggtgcagtttaacggcctggcgctggtgattatcgacgaacagcatcgttttggcgtacatcagcgtctggcgttatgggagaaaggccagcagcagggcttccatccgcatcagttgatcatgaccgccacgcccatcccccgcacgctggcgatgactgcgtatgccgatctcgatacctcggtgatagatgagctgccaccaggccgcacgccagtgactacggtcgctattcctgatacccgccgtaccgatatcattgaccgcgtgcgccacgcctgtatgactgaagggcgtcaggcgtactgggtttgtacgttgattgaagagtcggaattactggaagcgcaggcggcggaagcgacctgggaagagttgaaactggcgctaccagagttgaatgttggcctggtacacggacggatgaaacccgccgagaaacaggcggtgatggcgtcgtttaaacaaggtgaactacacctgctggttgccactactgtcattgaagtcggtgttgatgtacccaatgccagtctgatgattatcgaaaacccggagcgtctgggtctggcgcagttacaccagttacgtggccgcgtgggtcgtggcgcggtggcctctcactgcgtgctgctctacaaaacgccgctctccaaaaccgcgcaaatccgcctgcaggtactacgcgacagcaacgatggttttgtgattgcacagaaagatctggagattcgcggccctggcgaattgttaggtacacgtcagacggggaatgctgaatttaaagtggcggatttactgcgcgatcaggcgatgatcccggaagttcagcgcctggcgcgacatattcacgaacgttacccacaacaggcaaaagccctgatagaacgctggatgccagaaacagaacgttactcgaatgcgtaaaaagcggcggtgagaagaccgccgcttcatcggttaaccggcaaaaatcggcaacatcaaatacagcttaatcaccagcgcattgacgatatcgataaagaacgcaccgaccatcggcacgaccaggaacgccatgtgcgacgggccaaagcgttcagtgatcgcctgcatgttagcgattgccgttggtgtcgcaccaaggccaaagccacagtgacccgcagccagcactgccgcatcgtagtttttgcccatcatgcgccaggtaacgaagatggcatacaacgccatgaagatggtctgtaccaccagaatcgccagcatcggcaacgccagcgaagccagctcccacagtttcagccccatcagcgccatcgccaggaacaacgacaggcttacgttacccagcacggataccgctcgctcaaagacgcggtaaaagcccatcattgacagaccgttgctcagaatcacgccaacaaatagtacacagacaaaggtcggtagttcaaaagcagtaccagccaaaagttgcgcaacaattttccccaccgtcaggcagatagcaatcagcgcgatagtttcaatcagcaccagcgaggtgatcatgcggcccacatccggcttctcgaacgcagtcggaacttcctgatcatccggaataccgttcggtgtggtggagtgtttcaccagataacgcgccaccgggccaccgatcagcccgcccagcaccaaaccgaacgttgcacaggccatcgccacttctgtcgcattggtgaagccataacgttcaatgaacaatttactccatgcagcacccgtaccgtgaccgcccgaaagcgtaatagaaccggccagcagccccatcagcggatcaagccctaacaggctagccataccaatgccaatggcattttgcatcaccaacaggccaacaaccacaatcaggaaaacccccaccacacgcccaccagctcgcagactggcaaggttggcgttcaggccaatggtggcgaagaaagccagcatcaacggatcgcgcagggacatatcaaagttgacttcccagcccatgctttttttcagtatcagcagcgccagcgccactaataaaccacccgcaacaggttccggtatggtgtattttttcaaaaaggagacggaatggaccaacttgcgcccgagcagcaacgtcagcgttgcggcaacaagcgttgctaaagtatcgagatgaaacatagttactcctttgtgtccgcatcactctttcatactcgtcatacttcatcgcgcatttgcagtaaggcgaaatatgacgagtatcgagtcatgctttcctggttcgaattcttagctgaaactagaaaaatggcatggattttaagcagaaaacaactaaaagttatataaaaaagtacatttatctcatttaaatatttagatgaggatgtggcaaacgtttgcttttctctttcggtcagctaaaatgcccgctttgctaccacgggattgttttcgatgtctgtttccaccctcgagtcagaaaatgcgcaaccggttgcgcagactcaaaacagcgaactgatttaccgtcttgaagatcgtccgccgcttcctcaaaccctgtttgccgcctgtcagcatttgctggcgatgttcgttgcggtgatcacgccagcgctattaatctgccaggcgctgggtttaccggcacaagacacgcaacacattattagtatgtcgctgtttgcctccggtgtggcatcgattattcaaattaaggcctggggtccggttggctccgggttgttgtctattcagggcaccagcttcaactttgttgctccgctgattatgggcggcacagcgctgaagaccggtggtgctgatgttcctaccatgatggcagctttgttcggcacgttgatgctggcaagttgtaccgagatggtgatctcccgcgttctgcatctggcgcgccgcattattacgccgctggtttctggcgttgtggtgatgattatcggcctgtcgctaattcaggttgggctgacctccattggcggcggttacgcagccatgagcgataacaccttcggcgcaccgaaaaatctgctgctggcaggcgtggtcttagccttaattatcctgcttaaccgtcaacgtaacccttacttacgcgtggcctcactggtgattgcgatggcggccggatatgcgctggcgtggtttatgggcatgttgccagaaagcaacgaaccgatgacacaagaactgattatggtgccaacgccgctctattacggtcttggcattgaatggagtctgctgctgccgctgatgctggtctttatgatcacttcgctggaaaccattggcgatatcacggcgacctctgacgtttccgaacagccagtgtccggtccgctgtacatgaaacgcctgaaaggcggcgtactggcaaacggcctgaactcgtttgtctcggcggtatttaataccttcccgaactcctgcttcgggcagaacaacggggtgatccagttaaccggtgttgccagccgctatgtcggttttgtcgtcgcgctgatgttgatcgtgctgggtctgttcccggcagtgagcggttttgtacaacacattccagaaccggttctgggcggcgcaacgcttgtaatgtttggcaccatcgccgcctccggtgtgcgtatcgtttctcgtgagccgctgaaccgccgggcgattctgattatcgcgctgtcgctggcggtcggtctgggcgtgtctcagcagccgctgattttgcagtttgcccctgaatggctgaaaaacctactctcctccgggattgccgcgggcggtattactgccatcgtgctgaatctgattttcccaccagaaaaacagtaattcactggcggcggtaagataattaccgccgcagtctcacctctttcaccattcccgccttgaggattgcgcgtaaatcgtgcataactcccttatgtgcatttcacgggatggaagaccatgaaatttattgggaagctgcttctctacattctcatcgctctgttagtggtgatcgctggcctctattttcttctgcaaactcgctggggagcagaacatatcagcgcatgggtttccgagaatagcgactatcatctggccttcggggcgatggatcaccgtttttccgcgccatctcatatcgtgctggagaacgtcacgtttggccgtgatggccagcccgcgaccctggtggcaaaaagtgtcgacattgcgctaagcagtcggcaactgaccgaaccacgccatgtcgataccatcctgctggaaaacgggacgctgaatctcaccgaccagaccgcgccgctaccgtttaaagccgatcgtctgcaactgcgtgatatggcgtttaatagcccgaatagcgaatggaaactgagcgcgcagcgggtaaatggcggcgtggttccgtggtcaccagaagccggtaaagtgctgggtacgaaggcacagattcagtttagtgccggatcgctttcgctcaatgatgttcctgccaccaatgtactgattgaaggcagtattgataacgatcgcgttacgctgactaacctgggtgccgacatcgcccgcgggacattaaccggaaacgcgcagcgtaacgctgacggcagctggcaagtggaaaacctgcgcatggcggatatccgtctacaaagcgaaaaatcgctaaccgacttctttgcaccattacgctctgtcccgtcgttgcagattggtcgcctggaagtcatcgacgctcgtttgcaaggtccggactgggcggtggccgacctcgatctcagcttgcgcaacatgaccttcagtaaagatgactggcagacacaggaaggtaaactgtcgatgaacgccagcgagtttatttatggctcgctgcatttatttgatccgattataaacgcggaattttccccgcagggcgtagcactgcgccagttcaccagccgctgggaagggggtatggtcagaacgtcaggaaactggcaacgcgacgggaaaacgctgatcctcgatgatgcggcaattgccggactggaatataccttgcccaaaaactggcaacagttgtggatggaaacgacacccggttggttaaacagcctgcaactgaagagatttagcgccagccgcaatctgatcattgatatcgaccctgacttcccgtggcagctcaccgcgctcgatggttacggtgccaatctgacgctggttaccgatcataaatggggcgtctggagtggctcggcgaatctgaatgccgccgccgcaacgtttaatcgtgttgatgtccgtcgtccgtcgctggcgctaactgccaacagcagcacggtgaatatcagcgaactgagtgcatttactgaaaaaggcattctggaagccaccgccagtgtttcacaaacgccacaacgtcagacccatatcagcctgaatggacgcggtgtgccggtgaatattttgcaacattggggatggcctgaattaccgttgactggcgacggcaatattcagcttaccgccagtggcgatattcaggtcaatgtcccgctgaaacctacggttagcgggcaattgcatgccgtgaatgccgcaaagcagcaagtgactcaaaccatgaatgcgggcgtagtttccagtggtgaagttacgtcgacggagccggtgcagtaaaaataaggacgctagcggatatcagcgctagcgttccccgttattagcgcaaaattccatactcaccgcacaataaccatttcaccggttcatcttcttctatcgccggaaaacgtcctcccggctcaagaaaataattatcgtgttggtcatcatttaccatcgagatttcccagccgagaacaaacgctttttccgcccagaagcgatgatacagacgcggcggcaggcaaatgccctgccccggctttagcaccagcgtttcaccaggtttcatggtacgccgctgaccatcaacactcacggtaatgactcgttgatcatcacagagattggcttcgttggcccaggccaaccgcatgcataagtctccaccgccccgattgaggatatcttccattttgtgggtgtgaaaatgccagggagtctgctgatcttgttggatctgcaacattttctcagcatacggttttggatatgccgccgaccccagcgcgccgttgcgcatcgttagcagtgttagtcccgtttggttgaaatcaccacgaccaaaatcggtgatatcccaaccgagctgtaagtcgaccacttcttgccagttatcccgttcccgctgcagccagtcatccaccgtaaaataggcgaactctggcaaacaaacgcggaaggtctgcgcaatggcatgtgctttatcaataacataattaatttgtgaacgtttcattggcttctccgttgcgcatagcaagccaggcagcgccacgcattccgctactgtcgccgtgctgtgcttttacaatgggagtggtgaattgatcggtgaaaaccagtggagcgacttctgcgttcagatcggtgataagcagttccacattcgaaagcccgccgccgatcacaatcacgccagggtcaacaacattaacgatggttgccagcgtgcgggcaagctgttggcgaaaacgtgccacctgctgcatggcacaagcatcaccacgttgtgccagggtgacaatcgccgcaggagtgagcaagttaccagtcatctgttgatagcgttcactaaaaccgctgccggaaacaaacgactccacgcagttgtgtttgccgcaatagcaactgactgatggaccatcttcctgctccgtatagcctggcaacgtgatatgaccgcattcggcagcatttccccaggcccctataaacggtcgttgcttgatggcaatgccaccgccgcagcccgtaccaagcgtaataccaaataccacgtcataatcttgcccggcaccgtcgcaagcttctgatagcgcgaaacagttaccatcattggctatcaccaccggttgcccaagcaattgctgcaaatcagcctgtaacgcatgaccgttaatcacctgaatattcgcgtttttaatcaggccagtgagtggcgagatactgccgggtaaggcgatccctgtcagcatcggtcgttgaacgtcccgcctaatctgctcgataagcgccacaacgcatgagacaaattgttgatatgtcgacttttgcgtcgggcagcggtaacggcgaatctcccagccatgcgcatccatgacaacggcggcgattttggtcccaccaatatccaaccccagatagtgcatatctcgttccttgttgcgtaaaaggcgggtcaccccgcccttctggcttagtacagtgatgctttaccgagcgaaccgaacagtttcattttgtggcgaatgacttcccgcgccgcgttaatcgcatccggatagatgacgttcgggtcccaccagctctctttagcgagaatttcacgcactttctggaaataggcgtatttcatatcgctggagatattgattttgccgacgccgagcgtaactgattcagcaatctccgcgtccgggtttgccgaaccaccgtgtagcaccagcggaatatcaatacgtccggcaatgtcgcgcaaaatgtccatttgcagcttcggctgcatcccttttggatagatgccatgcgctgtaccaatcgccacagccagtgtgtcggcacctgtacgagcaataaaatcggcggcctgcgccggatctgtgtaggtcacttgtgaaacaccaccttctaccgacgttcctgtttgtccgatggttcccagttcaccctcaaccgacacgccaaccgcgtgagcgaggcgaaccacttctgcggtcagcgccacgttttcttcatacggcagcagcgaaccgtcgatcattactgaggtaaatccgcagcgaatcgcacgcaaaacatgctctacagaggcaccatgatcgaggtgcagtacaaacgggaccggactacgctgggtaatttcgcgaacgtgagcgaaaaaggcatcgcccacaaaatcatgttcgctgggatggatggcaataatcgccggagtatttgtcgcttctgcttcatccacgactgcgcgaaggaaacagttatccgccacattaaatgcgccaatggcaaagccgtgctggcgggtaggttgcagtaattctttcatcgaaactaacatgttaaatctccagtttcagcgtgtagtccgccctgccggtgcgttattgcactggcataaaggccatgacagaaaatgaatcaggctttgccgatagagccgctcgcctgtaaatacggtgtaatcgcttcttcgaaggccagttccatagctttcagcgcgtccaccagttcaatggatatatcgtgacagagggtatgcaggagcgcggatttcccccgttcaaaaatggccgcccccacgttgatttttgctacccccagcgtcgtacagagctggagctgatcgaacggcgtaccgctaccgccatgtaatgccagaggcacgctcgagcagcgcgaaatctccgccagacgctgaaaatcaatagcaggtacaacgccaggcgcgtacatgccgtgcgccgtgcctaccgagacggccagtagatcaatgcctgtctgcgcgataaacggttccacatcagtgggttgcgtcatcaggtctgcattggcggcctggtcgtaacgcggcgcatctgccagatggcccagttcgccttccacgcagagctgcgcgctggcggcgagttccaccaccgccctggtctggcgcacgttttcctccaggggaaaagcagaagcatcaatcattaatccgctgaaaccagcacgaaacgcctgacgaatacagtccggatttttgccatgatcaagcgccagagcgaccggtactgaggcagattccgcgagcgttttaaccactgccgccgcgacgggtgcaggaaaatgcgccagatgcccctgatagagattgagaatgatcggagcgcgattcttctccgccacgcggatagctgcgtgagcactttccagattcatacagttgatcgccagcaaggcgtaatgttcatgccaggctttcatcaccatacttttcatatcggcaaacatagggcctccggttattcgagggtgaaagtgatctcttcatctttcagcttttgatcgctcagttcgtcaaactcttcgtcgcgttccgttaccggtttcttccagagtgaaagcatcacgccacaaatcaccgtgcctatacccagcgccaggcaaaacagcagaggatgggtgaacagaggcacaacaaacatgccgccatgcggaaccggactctccacgccccacaccatgattaagccgcccgcgaccgccgatgccaccacacaagatcccactactcgcagcaggtcacgcgcggcgatcggaatgactccttcagtgatcatgcagatccccatcggaaacgcggctttcagcgcctcgcgctccgcacgggtgtatttatggcgtgtcagtaagaacgaaagtgtgatgccaaacggagggatgattgagccgacaaatttcacggcttctggtccgtagacgccactgaccagcaagccatcggaaaacagcgacatggttttgttgaccggaccaccgaaatcgaaggttgccatcgcgccaagtatggcccccatcaggaagcgcgatccgccctgcatcgactcgagcaaatgaatcagtgcttcttgtaaccaggcgatgggtttaccaatcagcgtcatcattaacagcccaccgataatggtgcttaataccggcaacaccatgattggcatgagtccttgcatcgactgcggcaggcggatatagcgtttaagtagcaaaatggtgtagcccaccaggaaaccacccaacataccgccaataaatccggtatggatttgcccacagagaaagccgacaatcaggcccggggcaaatccgggacgatcggcaatagaataggcaattgccgcgctaatcagcggcacaatcagccccattccccagccgccaatctgattaagcatccacgggattgttcctgttttttcaccaacatctgtaccgccaagaacttgccccaacgcaatacatatcccggcggccacaataaggggtatcatccacgagatgccggttaataaatgttttttaatttcctgtgaaaccggaattttattttctttcatattaagatccctccagtataaggatcatttgtttcccagtgatttttcgaccttttcaagaaattgaacgggcgatttaatgacgatctctgtctttactcgcacaatacgtttattggtgaagcgttcttctccttttattttcacatctacagcaagaatcacgacgtcagcagcagagatatctgccgcctgtaattcattttctgtaccaatggttccctgggtttcaactttaatggtatggcccagagcttttgctcctttgattaacttttcacgagcaatataggtatgagcaatacccgccgtacaggcggcaacacagacaatattcatgacatactccctgttatttagaagacatcggattgtgcatactgactaaagagatcaatgattttttgcggactcgtctcaactaacaattgttctatgatgtcatcatccgccagcgcgcccgcgacctgggaaagtaaacggatatgggtggtattttgatcttcaagacgtaccgcaaataaaataatacagcgcacgctactgccatccagcgtttcccagggaatatcctggcgggtacggccaattgccagcgtagtattaatcacagctgaagatttaccatgcgggatcgcaatatgattttcaaaaccagtcgagccttccgcttcgcgctgccagacatctttaataaaggtttcccgacaatcgatcgcaccatcttttttgagaagattagttaattcttcaatcgcctccgctttattcgtcgcttgcatatctaaaataacgcgattcgtattcaggatttttgttatgtccattcgtcatacctcataaaattctgacattaaatttcaacgacccgagacgtcgcatgatgtaatttttccgtaatcaccatttcagtgacccgcttaatatcggcatcattaaaaaaagcggtaacataagcgaccggcatagtgactgtaggcaaattaatggtcgaaataatcagttcgatattgtcaggcaaaacctgtgataaattcgctgctgaaataacatcaacaatcgtccattcaggaaatgctcgcagaatacggcttttcagtagatgcgaagttccgattccggttgaacagaccagtaatacacgtttacgggcaatttgccgctccatcgcagcctgaaaatgaacggtcaggtaacccacttcatcctcgctcactgcattctcaccccaggttttaaatacctgattcaccacatattgcgtcaaccgccagacatccgctaattctgctttaatatcttccagcaatggattacggatatgaatgcgataatttagacggttaatcagcggcttaatatgcaccaataagccatcatataatgcgctgtcttcactaaaatcgcagtccacgatgtcactgaataccgtaattaaacgccaggtaatcagacgcgcttcattgctggcctgcatatgtgaaataatgctaacatctttttgtccatcaatcgccacacctgatgaaatgatatattgataaataaaccagacttcatcatcgggcaatgtatgtgcaattcgttgttctatcttatgaatcatctgactggcaacattaaagatattttcatcatattgtctggtttgatcttcttctcttgataacgcattcccgtgcgtgttgcgatacatcataataaggatgtgagtaaaaatgttaacgtaataaggttctcccaaagaccaacttaattcattttccatatccagtaacaatgactggacaaataacacctcttcttctccaaaataatggactaatgctttatagcttccgggatccagacgtgaatacacgacaccttgcggctcattatggttaataatgccgttaatcagtaatgccattgcctgtcggacttgcccttcactaccttcaatatgcgtaccacttggactgcggatcaacgataaccccaacggcgcaagccaggactcaattactctcaggtcattaacaatagaggctccgctgataaagtagcgttctgacaatttactgatcgacgtttcattcggtgtttcacttaataactgcgacgctattttaacgcgcctggcattattcattacaccatcaatctcttcacattctgccaccaacaaatgatcaagatgcagcaaatcagcaatattctccgcacttaacatcacacccgcgccagcacgcttctcaacatttattctccattgtcccagccattgctcaagtaaacgtaaatcacgttgaatggttttttccgaaacatttaaatagccggcaatcgtaacaatagtcgtatattcccttcgaggtaaaaggaatcgtaataatctgttttgtcgcgaggtaatcatttgcattttttacccttatcacagattaagaagccccatatggaagagcttcagttgccatctctgagggtaaatataaagcagaataatttcacaacaatactaaaatctgtccgtaatccggacagtgataaaacaaagcaaggcggttaagggatatttttcaacacagatcacattttcgtgatgaataatcgtgatcatgctcgcaaatacgatggaagaaatatttattaccagatgtgagattatttaccggatacgacacaaaaccattcgtatccggcattcttcaatagattacaacgtaattgtcagcgcattcccttgaggagtcaccaccagtccctgctcactttcagcctgcgaaccgccttgcagaccatttactttcacaatattgcgcaagcacagtgtccagttcttcgcctcgcccgtaccagtcacagtaatcgtgttgccagtacgtgctgcttttaaagtaaagatcaccgaaccgtcagcatcgggcacttcacagacggcttcatgcccgtcttgcagattaaagaggtggaatgccgtaccttcgtgccacgcgtaatcgggacgttgatcgttgttgcccagcgccagtagggtgctatcacgcacataaacgggcagactcaggaagctgtgctgctgtttatgccagcgactaccgtcgagttcatcgttgtgccacaggtgtgtccagcgaccttccggcaggtagaactgcacatcgcccgcttctgtgaacacaggcgcaaccatcacgttgtcgcctaacatatattgacggtcaaggtaatcacaagccggatcgtccgggaactccatcatcatggcccgcatcatcggcgtaccccgggcgtttgcacgtgcagcttcacgatacagatacggcatcatgcggcatttcagttgcgtgaagaagcgcaccacatcacaggactcatcatcgtaggcccacggcacacgataagatttgctgccatgtaaacggctatggctggaaagcaaaccaaacgcgcaccagcgtttgtaaacgtgcgccggagcggtattttcaaagccgccgatatcgtggctccagaagccaaaacctgaaaggccaatagacaaaccaccgcgcaggctttccgccattgattcgtagttagcgtaacagtcgccaccccagtgtaccggaaatttctgcgcaccaacggaggccgagcgggcaaacaagacggcttcttcctcaccaacggtgtccttgagcacgttccacaccagttcgttgtagatgtacgcataatggttatgcattttctgcggatcggaaccatcaaaccactgaacatcggttggaatacgttcgccaaagtcggtcttaaagcaatcaacgcccatcgcgaccagacctttcagtttgtcggcgtaccatttgcaggcatccggattggtaaagtcataaatcgccagacctggctgccatttatcccactgccacagcgaaccgtccgggcgtttgagtaaataacctttctcttgtaactctttaaagacgggggatttttgcccaatataggggttaatccagacgcagattttcagccctttcgctttcagacggcggatcatcccttccgggtccggaaaagtcagcgggtcccactcaaaatcgcaccactggaaggctttcatccagaaacagtcaaagtggaaaacatgcagcggcagattgcgttccgccataccatcgataaagctgtttaccgtcgcttcgtcgtagttggtggtaaatgaagtggttagccacagaccgaaggaccacgcgggcggcagcgccggacggccagtaaaacgggtataacgatcaagtaccgctttcggcgtcgggccgtcgataacaaagtattcgagatattcactctcaacgctgaactgtactttggagactttctctgatcccacttcaaaagagacgcattgaggatgattgaccagtaccccataaccacggttagtcatataaaacgggatatttttatacgcctgttcagtacttgtgccgccgtcccggttccaggtttctaccgtctgaccattgcgcaccagggcagtaaagcgctctcccaggccgtaaactgtttcgccaacgccaagatcaagccgttcaaacatataattccgttgattattcgtgtcctgcacgtagccgttatttttcacctgactaccggtaatacgttcgccgttgcgcagaaaatccagtgaccagaactcacctttgctgacacgcgcacttaagttgccacttttaaactcagcgtaacgttctgtgttttcgatagtgaccttcacgtcctgcaaaatattgagcgggtaatgaggaccgttattcagcgccccctgaaaatgctcaatccgtacaccgacaataccttcctgtggggagaaaaagcgcagcgtaaataaaggcgtatcaagctgccaggtacgttcacgcacatcacgaggggcagcatagaccaccatttcattatcctgctgttcaacctcgaacacctgaagcgggtgaatcaaattgaggccaggttgaatcaaccagtttccgtcgctaattttcattgccgttccttagttctgcacttcttgagaggtgaattgttgctggcaacggcgtttgccctgcgccagctgttccataacggttttcagattgtgcgtcgtgagcgagtagtagcgtttagcgataatcgcgctcagcaagtaacagatcgccggaacaatcgtgaatagcgcgataatgatgctaattgtgacgctgttctgcgctttttctgccgcatcatatccgccataagccagcatccagccgataagggcaccaccgaaggccaaccccagtttgagcacaaacagcgtgccagcaaaactgatcccggtcaggcgtttaccattgcaccactcgccgtagtcgacggtatcggacatcattacccactggataggtgtcaccagttgatgcaacacaccaatcacgaagatgaagacaaacatggtgatgctggcctgcataggaacaaagaacatcgcgaggctaatcactgccagcagggcgttcgtccaccagaagatagtgactttacatttccagtcggtcagcggtttcgccagtgcggaaccaatcaggttacccacgcaataagtggtgagaaaagcgacaaatacttccggcgtgcccaaaatccatgtgacgtaatacatcatcgccccaccgcgtacgcacaccgccaggatattgaaaatggtcaggaaaccgacaatacgccactggtcgttttgccagatatcacgtaaatcatcccgcatagacgtcgttgtaggtggtgcttcaacgcgttctttagtggtgaagaaacagaatgccagcatcataaatgccaccacggaaaggaccgcgataccgccctggaaaccgagtggtttattatcaccaccaattaaattaaccagtggcatcatcagaacagtagagagcatgcctcccgcggtcgccagcacaaaacgccaggattgcagcgagatacgctgagtcgggtcattggtgattacaccacccaatgcgcagtaagggatattgacgatggtataaagtaaggtaagtagggtgtaagtaattgctgcataaatcatttttccgttcatactgagatctggcgtgctataggccagtacacagacgatcccgaatggcagtgcgccaaacagcacccacggccgaaatttaccccagcgagagcgcgttcgatcggccaacaaccccatgcaaggatcggaaatcgcatccagtgcacgagcgaccaaaaacatggttccgacaaatccggcaggaatgccaaaaatatcggtataaaagaacatcatatataacattacgttatcgaaaataatgtggctggcggcgtctcccatgccataaccaattttctctttaacggacaacacttcactcttcatctgcttttccttgatgctataggggtgctgagaccgataacgcattttgtaaaccatccctgcgagagcgaatattccgatatctggttattaatttatgattcttgttttatgtgatcgtggtagcgttaatttcgctcatatatcattgtaaaatatgagttttatatgaactataatgcttttgtgataatacgctgcgtgtattaggcggaaaaaactgatctgggggatgtagaaactcaaggaagtagctataatgcgccccgcctccatgtagcaatcgaggcgcggaagatcgtcgtctccggtgaggcggctggacttcaaatccagttggggccgccagcggtcccgggcaggttcgactcctgtgatcttccgccaaaatgcctctcctgaactctcccgacgtcaacaacactccttcggaggcgacatgtcagacaaagacttaacccagcccccagcaggcgagtttattatgtttgccagcggtgacggaagagtgcgtgttgaatgtcgctttgagtcagacacaatctggttatcccaggcggcaatggctgaactgtacgataaagatgttcgcactattaacgaacatttaatcaatatattttccgaaggtgaacttgttcaaaactcaaccatccggaaattccggatagttcgccaggaaggaaaacgtcaggtttccagagagatagaccattacaacctcgaagccattctcgctgtcggctatcgcgttcgctcgcctcgaggcacgcaattccgccagtgggcaacgcagacgcttcaggaatacctgatcaaaggttttgtgatggacgatgagcggctgaagaatccgcctgtcggttcatcggttgtgcccgactattttgatgagatgcttgaacgcatccgcgatattcgcgccagcgagcgtcgggtatatttgcgggtgcgggagatctttgctttagctgccgactatcagccatcgcttaaagaaaccacgcaattttttcaaaccatccagaataaactgcattttgcctgtaccgggcataccgctgcggaactcatccacaaacgagcagatgccagccagccgcacatgggcttgaccagttataaaggtgaagaggtacgtaagggcgacgtgacggtggcaaaaaattatctcacccaggatgaggtcagcgaacttaatcgcgtggttaatatgtggctggactttgccgaggatcaggcccgtcgtcgtcagcaagtctttttgcgcgactggcaggataagctggatcagttcctgcaatttaacgaccgagaggttctacagggcgctggtaaaatcagcaagaaaatggccgatgaaaaagcgcaggcggagtatgttcagtttgccgaacaacaacggcgcttaaaagaagccgaaggcgagaaggatatcgctggtttgctacagtggaataaagagtcgaaaaagtagcccggaatccccccaaacgccatacgcaaaaccatttgggggtacttatggggttactcatttatcaaattcaaaatataaacattaaatcaataacttaaccatcaaatgcgactcctgtgatcgccaaaatgcctcttcagtgatccccatcctgcttatttctgagcaacctgaccctgctgatgtatctggtagtatgacagagtgattcgtttttcttgccgagtgtacgaaaacgtcttccttgccaccgactatcaaccgtcactcaaaaaaacctctctttttttcaagctatcaagaataagttgcattttatctgcaccggacaccagccatccatatatggcttttacctgctacaaagatgaagaagtgcataaatgtgatgttaaaacaatcaaagaaaaattacatgcgcaataatttcactataacattataatccatggtgaaaataacactgcacaaggattgtcatcatcaaactcatcggaactattttttctgtcgtcattggtgtaatactgattgtaagtatcctttcaggagattatttttgccgtgtggggcatggaacttgtaaagcagccaaaagcgctaggcatttaattgaaagtaaagagaaaaacagaagtagtcgcgtcaaagtctttagcacgcatattaatttgagtcatccagcggcatcctggctagcaactcaaacttgcgctaacaatatattcaatctgcttcaaaacaataatgccatttatttattcaaaaacgataataaaattgaactgcgaatggggtatgattcttttttctctattgaaacgattgataaaattaacaaagaaaacatcaaagaaataaaactaaaaaatgatacaacatatgtttctcttcctaatccaaccattttaataaccaacgacatcaacacctgaacgacagttttctatttctgttctggatgatgataacaaagaaaatctacctaccgataccgcaccttgttttacaattggtattcctgatgaatatactaaagccatagagttattgaacattaaataattaaatttcatattgagtttttttaaacaccatatgaataattgttatatgtcattatttcctccattcactaaaactgattgattactctactccctcaccgtcatcggtagtggtatccttaacgtatattgatgaaaagacaaaacagtatgcagagggaaaaatgggttccaccagaaaggggatgctgaacgttctgattgccgccgtgttgtggggaagttcaggggtctgcgcgcaatacatcatggagcaaagccagatgtcgtcgcagtttttgactatgacgcgtttgatattcgccggtttgattctgctgacgctatcatttattcatggtgataaaatcttttctattattaacaatcacaaagatgccattagcctactgattttttccgtggttggcgcgctaaccgtacagctcacttttttgctaaccatcgaaaaatcgaacgcagccacggcaacggtgctgcaattcctctcaccgactattatcgtcgcctggttctcactggtgcgtaaatcccgcccgggcattctggttttctgcgctattttgacatcgctgatcgggacttttttattggtgacacacggtaatccgacgtcattatcgatctctcctgccgcgttattctgggggattgcctcggcatttgctgctgcattctataccacctatccctcaacgctgattgcccgctatggcacgttaccggtcgtcggctggagtatgctgattggcggtctgatcctgctgcccttttatgccagacaagggacaaactttgtcgttaacggcagtttgattctggcgtttttttatttggtggtcattggtacgtccctgacatttagtctgtacctgaaaggagcacaattaattggcggtccaaaagccagcattttaagctgtgcagaaccattaagtagcgcgctgctctctttgttgttgctggggatcaccttcacattgccggactggctgggaacgctgctgattctgtcatcggtgattttgatttcaatggattcccgccgccgcgccagaaaaataaatcgtccggcgcggcatgagtgagaattaccagccaggcaccgcgcctccgttaaagatggtttctgccgctttagcgacttcgggtgattgataagattgcagaaattccttcacgttttctgcattcttattatcttcccgtgccaccagaatattcacatacggcgaatttttatcttcaataaatacgctgtcgttaaccggagaaagtcctgtttgctggatgtaagtggtgctgataatcgctacatccactttcgggtcgtccagtacacgtggcaactgtgccccttccagctccattatctgcaaatggcgtggattatcggttatatccaacgcggtaggtaataacccttttccttctttcagagtaattagcttctctttttgcagcagtaaaagcgcgcgaccaaggttagtcgggtcgttggggatcgccactgtcgcaccttcttttatttgcgccactgttttgatttttttggaatagcccgccatggggaagacaaacgtatttcccaccgctaccagtttataaccatgcgcctgattatcttgttcaagaaagggtcgatgctggaagacgttcgcatcaagctcgccatgatttgtcgcatcgttcggtagcaacgaaccgctaaatcctaccagttcaacatcgagaccatatttctcttttgctacctttttagcgacttccgcgacatcttgttctgcgccattaataacgccaactttaatatgcttttcatcgctgctgctctggtcgcaacctgccagcagaactcctgccagtaataatgcggcccccgcccgtagatgatgtgttgtcagtttcatttttttatccttttattaatgattacctgactatagcggtaaggtcgctgcagtttaaaaaacgaaacgctatcgataagaataaaaaggaataaaagtggaatataaagtctggcacttcttactgaccacgcaaacacctttcgtacagcatgatgagagcggcaaaagcaaactacacttatgcttcattcgatgcacatttgcagaaggttgccgctatgaagccaacgatgctactcatgattaccgtattcctgatttttccagccatttctcaggccgagtcgccattcagttctctacagtcggcaaaagagaaaaccacggtattgcaagatttacgtaaaatttgcacgccacaggcgtcattatcagatgaagcgtgggaaaagttaatgttgtcagatgaaaacaataaacaacatatacgcgaggccatcgtggcgatggaacgtaataatcagagcaattattgggaagcgttgggtaaggtagaatgcccggatatgtaagaacggcaacaaccactgaccaacgcttctttacctgatatcaggatttcttcattttcacctttgcagtcaccaacaatgcagtcagcaacatcaatgtgccggacaacatcagcggcgaagtcagaccaatgttatccaacgcataaccgccgattgccgcaccgcaggtgttagcaagctgaataacggccacctgaatagatccagccttttctgcctgatcggccaatgagcgagtgatccacgttgaccaaccaacgggaattaaagcaaaggtcagcccccagataatcgccacaccagtagcaacaattttatcgcttccccacagtgtcagtaccagcgcgctcagggcgagcacaaacggtgcgcccgctaaggccagtttcaccgaacgtttgagaataaacgacgaaagcgatgtcccgacaaagctggcgataccaaaactcagcagcaccagggttaagccatcaacaccgaatcccgccagattcatatacactgggcgaatataagtgaaaaaagcaaactgtccggcaaaggacataaagatggcgatcatcccggccatcactcccggacgttgtaataagcggaaagtattttgtttctgatgcgaaggttcacctggcagcgaaggcagtgatttgataatccagaaaatacacagcacgcccatcgccgccgccgcattaaagacattgcgccaaccgataagctcgcctaaaaaactgcccaacggcgcggcaatcaccagcgcaatagaaaccgcgccgaagatcaccgacagcgccttcggcaccgtacgcggcggtaccagacgcatggtcagcgacgccgacatcgcccagaacccgcccagcgccagacccagacaggcgcggccgattaacagcagactgaatgagttggcaaaggaaaccagcaaacaggaaagcgtcagcaaaacggcgaacagaatgacaacgtagcggcggtcagtggcctgaatggtctgggtaataaacaaactggcaaacatcgccacaaaggcggtcacggtcaccgattggccggcaaccccttccgaaatgcctaaatcctgggccattggcgtcaacaaactgacaggcaaaaactcaacgataatcagacaggcgacgcaaaacgccaccgagaaaacggctgaccagttcggtcgggtgatggcatccgcgccgcggttttcagcaataaattcactcatggtgttacccgtggcatgtttcagagggaaagccgaccactttaacattgaaatgtgtgacgtatttaacgtttttgcaacttttacggtgttgcttgagctggagttaagatcgaaacggaacagggcaaagattaccggatgcggtgtgaacgtcttatccacccaccaggtcaggcgcggtctgtaggctgataagacgaagcggttttaatgcagccagtgaacgccctcggcaggctgaaagaacgcgttatagcgcatctgaaaagcattgatatcctgcatttcaggttcggtttcgcgcagaaaacccagcgccagcctgacctgagcatcagtaatcggcgcggcaaggcgggctttttgtaaaatccgatgccattgcagcaggttctgttcgctaccatcgacaatgacaatttgccagatgagcaacacctgcgcggcgttttgcaggtgcgactcatccgggcgatgcaaataacgtaaaaattcgtcaccggctgactttcccatttgatcgaccatcgactccacgggtacgacatcgatgttcagccgatcgctgagacggcgaatcgcttttctggccccggatgtcagcacccgaaaaccaaccacaaacactaccgccagcgtggcgagcattatccagatcatgagttctcctgcgtaatcagaactcatgatatctggaaaccctcgccagttactaatccaccagaataatcttcagtgcaaacagagttgcgaccaccaccacacacaggttcagatcgcgccagcgcccggtgcacactttcatgatgcagtacgacataaagcctagtgcaatcccttcggtgatcgagaaagtaaagggcatcatcaccgtggtaataaacgcaggcaccgattcggtaaaatcatcccagttaacgcgcgccaggcttgaagtcatcagcacgccaacaaagattaacgctccggcggttgcgtaaggaggaaccatcgccaccagcggtgagaagaacataactaacaggaacataacgccgactacgacagccgtcagccccgtgcgaccaccgacagccacacctgaagtactttcaatataggcggtaacagacgaggtaccgataaacgcacccgccaccgaactgacgctatcaacatacagcgccttattcatattggggaatttaccgttactatctattaagccagctttatcagtcacaccaattaatgtccctgatgaatcaaataagttgatcagcataaaggagaaaatgataccggcgagttcaagtgataacgcaccgctcaaatccacttcaccaatgacgccgctaatatcaggcggaatggaatagacgccgctaaaatgaacatcaccgaaaaacaatccacagcaagacgtcaccacaatagaaacaagcaccgcggcatgaaaatgacgtgatgacaacacggttataataaaaaaccctaaaatacctaacaacacgccgtgagaacttaaatcgccaatcatcaccagggtgtctttattggcgacaataacgccagtattttttaatcccattaaggcgataaataatccgattccgctggtgataccaatacgtaaacttaatggaatgttggagatcatccagtaccggatacgaaacagcgtgagcaaaaatagcccaactgtgccccagaatatcgcgcccatcccggtctgccaggagatacccatcgcccccacgaccacgaaggcaaagaaggcgttcaggcccattgccggagccagtgccacgggtaagttagcaaatacccccatcgcaatactgccgataccggcaatcaaacaggtggtaacaaacaccactttcgggtccatttgtgccgcgccgaggatttgcgggttcacaaaaacgatgtacaccatggttaaaaaagtggtcatccccgcaatcaattctgtgcggacggtggtcccatgctgagatagtttaaataatcgcgaaagcgtccctgattcattactcacgtaatcggtattgtcattattcatttttttgtccattggaggagatttaatcccttgcttttgtaaaacaaatgacaacaacggttcagtgataattatcacatttcaattgcacattaatggatattctttaataatctcgcgacgtttctttatgataaataataatcaaattgataaaatcaaaatgagaaaaatatgaataattctattaaccataaatttcatcacattagccggactgaataccaggaattgttagccgtttcccgtggagacgctgttgccgattatattattgataatgtctctattctcgacctgatcaatggcggagaaatttccggcccaattgtgattaaaggacgttacattgccggtgttggcgcagaatacgctgatgctccggctttgcagcggattgatgcccgcggcgcaacggcggtgccagggtttattgatgctcacctgcatattgaatccagcatgatgacgccagtcacttttgaaaccgcgaccctgccgcgcggcctgacgaccgttatttgcgaccctcatgaaatcgtcaacgtgatgggcgaagccggattcgcctggtttgcccgctgtgccgaacaggcaaggcaaaaccagtacttacaggtcagctcttgcgtacccgcactggaaggctgcgatgttaatggtgccagttttacccttgaacagatgctcgcctggcgggaccatccgcaggttaccggccttgcagaaatgatggactaccctggcgtaattagcgggcagaatgcgctgctcgataaactggacgcatttcgccacctgacgctggacggtcactgcccgggtttgggtggtaaagaacttaacgcctatattgctgcgggtattgaaaactgccacgaaagttatcagttggaagaaggacgccggaaattgcaactcggcatgtcattgatgatccgtgaagggtccgcagcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtaccgctgcatgtggcatatcgcgtagccagctggtcgacggcgcgccattttggtctgaatcacctcggcttactggcacccggcaagcaggccgatatcgtcctgttgagcgatgcgcgtaaggtcacggtgcagcaggtactggtgaaaggcgagccgatcgatgcacaaaccttacaggcggaagagtcggcgagactggcacaatccgccccgccatatggcaataccattgatcgccagccagtttccgccagcgactttgccctgcaatttacccccggaaaacgctatcgcgttattgaggtaatccataacgaactgatcacgcactcccgctccagcgtctacagcgaaaacggttttgatcgcgatgatgtgtgctttattgccgttcttgagcgttacggacaacgactggctccggcctgtggtttgctcggcggctttggcctgaatgaaggtgcgctggctgcgacggtcagccatgacagccataatattgtagtgatcggtcgtagcgcagaagagatggcgctggcggtcaatcaggtgattcaggatggcggcgggctgtgcgtggtccgtaacggccaggtacaaagtcatctaccgttgcccattgccgggctaatgagcaccgacacggcgcagtcactggcggagcaaattgacgccttgaaagccgccgcccgtgaatgcggtccgttacccgatgagccgtttattcagatggcgtttctttccctgccagtgatccccgcgctgaaactaaccagtcaggggctgtttgatggcgagaagtttgccttcactacgctggaattcacggaataataaaaaaaagcccggcgtcatgccgggcaaaagtcaccagttacgtttatgccactgtcaactgctgaatttttttctcgcggcggattttgcgttcttccatcaccgccactatcgccatcaggcagatacaaccaatcgcggcgatatccagcgcggcgaaggtgcctgcccagccggtaaggccaaataccggcgtcccatcggcaatcattcccagacctaacttggcaaagctgtcaccaatcaggtaagcgaaggtgcctttaataccatcggcagcgccaatcgcttttttaggtacaaagccaacagccgccacaccaatcaacaattgcgggccaaagaccaggaaacccaacgcaaagagagaagccaggtagatatattcgttgctggcgtgttgatacacaccgagcgtggcgataatcagcgccagcgcgatacaggccaccaggccacggcgaccgttcgccaggtcagagagccagccccacagcagcgtaccgaccagcgcaccagcttcaaacagcgtaaagccctgaatcgccaccgctttagagagtttcagttcctggaacgcatacacggttgaccactggtcgataccaatacgcaccacatagaggaaaatgttggcaaagcacagcagccagatcactttgtttttcagcacatactcaacaaagatctgccacttggtcatatcggtagattctgtctctttatcctcttcactgatctcctcgccaaacagctcttcagctttgccgaggccataagattccggggagtcgctgccgtaacgcagaccaataaaaccaacaatcagcgcgataatcgacgggaaaataaacatgccgatgacatgaccatcgaacaggtaatttgcgccgaacagcgccacacctgctgcgcctgcaccaccaaggttgtgagaaatgttccagaaaccgaggaatgtcccgcgtttacgacgcggcgtccatttggtgatggtggagtaactgcacgaaccgccggtactctggaaaaagccgctcaaggcgtagaaggcaatcatcaggaacaggctaaccgagccgctgcccatactggcactgaagcccagcatacaaatggcagacaggatcagcatgaacggcaggaattgtttggtgtttttgccgtcggcgtagtaagaaaccagcgttttacccacgccataagtgatggagaagcccaggccgatcatccccagctgcgtcatgctcaacccgtaggtcgagatcatgtcgttctgcgcgatgttaaagttcttgcgaatcaggtacatcgtaaggtagccgataaagaccaccaggtaggattgcatgaacggtttgaaccacattttgcgccgcacttcgagcggaaggtccagggtcggcttgcgaacctggtttaagaaagccagcatgggttactcctgaaatgaatacctgcgtgaggcatgcattgtaaaaatcagcagcaaatcaggcctgagatagcgtccaggcaaaacctggaaaatttcttagttttgccggatatgaagtgaaaaggtgagatgcatcacgcttctcgcggtgtctgggcgttcaaaaagggcagtaatagcagtgcggaaatcccggcggcgatggcgataaccacaaaaaatccgctccagtgccaggtatcgagtactttcgccagcggccaaccagcaagcgacgcaccaagataagcaaacaagccgacaaatcccgtcgccgcccctgccgcctctttgtgggaacactctgccgccgccatgccgattaacatctgcgggccaaagacaaaaaaaccaatggtgaagaagcaggttgcctgcatcacgtagctggcaaatggcatcagccacagcgagccgactgaaagcaaaattccggcggcgaaaatcaaattcatcggcccgcggttgccgttaaacagtttgtccgaaccccaacccgctaccagcgcaccgataaatccgcccagttcaaacattgtcactgccgtattcgccgtgaccagatcgacgcccagcatctcggacatatacaaattgccccagtcgttgatcgccgcccgaaccacatagaccagcacatagcaaaacgaaagcagccagatatacggattcagcaacacatatttggtgaggatctctttacgcgtcagccctgccccttcttgttgttgagcaatctccagtgcgtcgtgccgccattcaccaaccgccggtaaacctaacgcctgcgggcgatcgcgcagccgccagcagagaaaaatccccacgactatcgccatacaacccgcaatcatcatcccggcacgccagccgtaatgcagcgcgctcgctgccatcacaatgggaatgagtgcgccgccgacgttatgcgccgtgttccataatgcccaccaaccgccgcgctcggtacgagaataccaggcggttaacagacgcgcacacaccggtgaaccccagccctggaaaaaggcgttcaacacccaaagcacggcaaacgcccatagcgacgtcgagaagccaaacagaatgttgataatgcccgtggcaataagccctatccccataaaataacgggcatttgagcgatcgctgacaatgccggagacaaacttcgacacgccgtaggtaatgtaaaacagggtcgctaacaggccaatatcgctacggctgagcacgccgttagcaaggatttctggtacggcggcgttaaaacttttacgcgtgaagtaaaacagcgcgtaacccagccagatggtcagcagaatatgccgacgccagtagcgatagcgggcatcaatttcatgtttatcagtcattaatggcgcatcggcgggcgctttcagaaacggcaacatcatcgaaccttagacataacgttgaggtagagaaacgctgacacgcgtgccgtgcagacaggaaatggtcaatgtgccacccagcgccgttacgcgctcgcgcattccggtaaggccaaaaccgtgttgcccggaatctggcggtaaaccgctgccatcgtcttcaatcaccagcatcaaccgttcatcctgctgccagccttgcagggtgaccgcgctggcatcagcatgtttcacaatgttgttcagcccttcctggcagacacgaaacagcgtcactcgctggttttcgcttaacgctgattcatcgattcgccattcgagatggctgacaatgccgcgcccttccagctccatttcccgcatcagtgagcggatggcctgctccagggtgagatcatccaactggcgcggacgtaaccgacctaacaaacggcgcaccgcgtcgtaaacgcccagcgatagttgttcgatgagctgcccgctctgtttcacgctggcgttatctgccgccagccgctgaacaatgcccgcttgagttcgaatagcagtaatggtctgaccgatatcatcgtgcagctcacgtgccacatcacggcgcacgctctcttcggtttccagcaaccgttcagcgagatgctgattgcgcgccagttccttttgcagcgactggttaagttcacgcaaccgctggatgcctgcgcccagtaacaaccctgtcagactttgcaccaacagcgagagcaataaatccaccggatgatcgcgccaggtttgactggcgatcagcgcgatggcgttcatcaatgtcgcaatcagcgctccttgccaaccatagtgccaggccagcgcgataatcggcagcgccagacagaatggcgtaaagcgcgacagttcgtctggcaatcccaactggagccagagactgataacaaacagcagcaagtaccagaccagatgtcgcccgcgccagttgattggctgagaaaccagtgacgggccgagcggcagccaggtgttattcgccagatagtgccagaacaccagacatatcggggccagcgtcaggccgccagttaaagtcagcagcagcgcattccacgactctttgccgtgccaaagccagggcagcgactgcaacaacgccgccgcagttaacgccgcaccctgtaacagcaaggtgcgccagtcacgttgatggcgatagcgcgagatcagcgccacgggcaataacgtcagtaaactaccgatcatcaataaggagaaatgggttaaaccgaccgcctgcattagccagtaaatcagcagccactccgcacccagtagcaccggccagtatccgcgcgggcattgcagcattagccctagccgcaggccaaacggaaataacagcaccgccatatcagggcgctcaaccaggtgcaggctgatactccacaggcaaaaccatgcggcagagaagataaaaaagcaggcaataacggtaattaagcgggagaacaacgtcttcatcaccagccatcaaacatgcggcgcgccagttcaacgtcgttactgacgcccagtttttccatcagattggcgcgatggacgtgtaccgttttcggcgacaagcccagttcggcggcaatctctttcaccgccattccttgcgccagtttttctgccacctggcgttcgcgtttggttagcgggtcctggcgaccggatgccagtttaatggcaatatccggcgtcagataacagccgccagtggcaaccgtatgcaccgcagcaatgagttcatccgggctacagcgtttggagagaaagccgcgcgccccggcgttaagcgcctgctcaaccagcgccggactgtcgtgaacggagagcataattgtcgccatgcctttcggcagctggcttagaagctccagaccggagatatcaggcatggagatatcgcaaatacacacctgcacaccgcaccccggcagccccgccagcgcctcgcgccccgaaccaaactcggcaactacctgcaaatcaggttccagccccagcagctgcgcaaagccggagcggacgataaggtgatcgtctataagggcaacggtgatcatgatcttgtcctggagggtaataaaacgcgcttaccttaacgataagcgcgatgttgttcaagccttgagcggttactgaaaaaacaccgcaatcttgttaaacatggtcggatcggactgattacgctgcactttcaccacatcttccagcttgtcgatttggcttatcatctgctccagacgctggtcgtcattgaccagtagccagatgtggcttttgtcgctgtcctgaatcggcaggcagagaatgccttcaacgttaaaagcgcgacgggcaaaaaggccacaaacgtgggtcattacacccggatggttgcgaacggtgagttccagaatcacgttatcatgagttgtgttttgcatggcttattcccccaccatttcagtattcgccgcacctggcggcaccatcgggtacactttttcttcggcatcaatgcgcacatggatcagcgccgggccagggcgattgatgatttcctgcaatgcagcctgcggatcggcttcgttattcaaatcacaggtttcgaggccgaatccggcggcaatctgcataaagttgattttgcccggataggtagcggcaaaaacgccctgcttgtagaacagactctgttgctgatgcaccagccccagcgcttcgttgttcatcaaaatgattttaacatccagctgattttcactggcggtcgccatctcctgaatattcatcatcaggctgccgtcgccggagaagcacaacactttgcggtccgggttcgccagcgccgcgccaatcgccgcaggcaggccaaaacccatcgtgcccagcccgccggaggtcagccactggcgtgggcgattgagcggataggcttgcgcggtccacatctgatgctgacccacgtcggtggtgataatcgcattgtcatcgacacaggcggcaacggcgttgatcaggccgtaatggcttaatggatcgcacgctttcgggattggacacgggaattcacgctgcaaatccgccaccaactggtgccactctgcacgcggttgcgcttccaccagcgggatcaactgcgccagcacgtcatcaacatccgcctgaattgccacatgcggttgcttgattttgcccagctctgcgcggtcgatatcgacatgaataattttggcattcggacagaactgctcggttttgccaatcgcccggtcatcaaaacgcgcaccgagtacaatcagcagatccgcctcctgcaaaatatagttggtgctgcgcacaccgtgcatccccagcatacccagcgacagcggatgcgcttttggcaacatacccagcgccattaaagtcatggtggtaggcagttgtgctttctccgccagttcacgcactcgcgcaggcgcgttgatcacaccaccacccagataaagcaccgggtgtttggcggcgttaatcatcgccgccgcgtcacgaatactttcttcgctaaaggcgggtgcggcggctttttctgccatagcgggctgtgtttcaatctcaaaaactgccgtttgcacatccttaggaatgtctatccacaccgggccagggcggcctgattgcgcaatacggaaggcatcgctcatgacctgcgggagttcttcgatatgtctgaccagatagttgtgtttggtgatggggatagagatgccgtaggtgtcgacttcctggaaggcgtcggtgccgatcatcgaggcgggaacctgaccagtgatgcaaatcagcgggatggagtccagcctcgcatcggcaatggcggtcaccaggttagtcgcacccggtccactacaggccatacagaccgccggtttaccgtcggtgcgcgccattccctgagcgataaaccccgcgccctgttcatggcgagccagaatatggcggatttgcgtgctttggcttaaggcatcgtaaacaggcaggatagaaccgcccggaatacccgtcacaatcttaatgccctgctgttccaggaaatgaacgataaattctgcgccggtaaagcgcttacgcgtcgatgttgtgcccgaacttgccatgctccagtccttttcttctgggccgactttccgggaggagcttaaacgaaaaaccccgcccggtttgcgccggcggggttttggaatcgtgtgttgttccagtccctacggcgcattgccgacgaccaccaccacacgcacgacgaccactgcggcggatggcgcagttggtagtagttttgcgttgaacatggaagtagtcattggggaccttgttggttttgtgtttaacaatatttatacaagcacagctttacaggggagacaatggaaaatttttcttccggataaaaatacgtggcagatcacattttgaactgaaactcaggcaataaagcatcatcacctgaaagacggtcagattgttgacagagtgcgccttattcatgtcgaatacagcgtaaacaccttaccctaccaaccgcaccatcactgtttccggcaacatttattgccgcttttgtttacatattctgccgctaaacaattccccattcctggcgtatatctggctaacattcatcaatgtgatagattcctctcccgcatttatgggaatgcgtagtgacttattctaattatttttataaaagcatccgtgataatgaaaaggcatagaaacgtcaatttgttattgatgttggtattactcgtggccgtcggtcagatggcgcaaaccatttatattccagctattgccgatatggcgcgcgatctcaatgtccgtgaaggggcggtgcagagcgtaatgggcgcttatctgctgacttacggtgtctcacagctgttttatggcccaatatccgatcgcgtgggtcgccgaccggtgatcctcgtcggaatgtccatttttatgctggcaacgctggtcgcggtcacgacctccagtttgatggtattgattgccgccagcgcgatgcaggggatgggcaccggcgttggcggcgtaatggcgcgtactttgccgcgcgatttatatgaacggacacagttgcgccacgctaacagcctgttaaacatggggattcttgtcagtccactgctcgcaccactaatcggcggtctgctggatacgatgtggaactggcgcgcctgttatctctttttgttggtactttgtgccggtgtgactttcagtatggcccgctggatgccggaaacgcgtccggtcgacgcaccgcgcacgcgcctgcttaccagttataaaacgcttttcggtaacagcggttttaactgttatttgctgatgctgattggcggtctggccgggattgccgcctttgaagcctgctccggcgtgctgatgggcgcggtgttagggctgagcagtatgacggtcagtattttgtttattctgccgattccggcggcattttttggcgcatggtttgccggacgtcccaataaacgcttctcaacgttgatgtggcagtcggttatctgttgcctgctggctggcttgctgatgtggatccccgactggtttggcgtgatgaatgtctggacgctgctcattcccgccgcgctgttctttttcggtgccgggatgctgtttccactggctaccagcggcgcgatggagccgttccccttcctggcgggcaccgctggcgcgctggtcggcggtctgcaaaacattggttccggcgtgctggcgtcgctctctgcgatgttgccgcaaaccggtcagggcagcctgggattgttgatgaccttaatgggattgttgatcgtgctgtgctggctaccgctggcgacgcggatgtcgcatcaggggcagcctgtttaagctcacgtcaccgcagcatcgtcatcagctccatgggagaacgatgctgctttatcagatcacgcatcacccgcatatgcggcgcggagtaagaataaaacgcctgatagcccgcacaaagcacgttgtctggtttatcttcccgagcgtgcgggcacagccgatgccagtcgcacgcctggcagtcacggcgcggttgcgacttttcgctgccacaccatttttgtaaggtggtgtcaaaaagttcaatcgaaatacgactgatatctgcccgcacccaacactcgaacagggcaattaaaaatttcccccacagctctgctgtcaccgaagcggccgtcagatcgccccggtcatcaaattcaagatggggaataagctgtactgagcggatgcccagctgtttgaaattgtgataaaaatcggcaggttgcagagcatccttatactctacaaccagtttatgcctgtcctcttcagcatcaatgacctgacttcctgtcatgcgactctctcaataaatacgataagttgatgtatatgcgttacagcaaacagtattgcgagagataacaccgcgagggagatcaaaaatttgtcacggactacgtgaaattgggaaaaatcgctattcgtgacatccattaaattgcgattacgggtgtagtgccagaggatcagcgccacgatggcgaggatgccaatcgaaatccagaataacatgcccgcctggtgccagttgtgtttgacagccaacgccatcaacgcgccgtagcccagcatagtacgaaaccacgccagtgatgtgcgttccggctgcagccctgggtcggcaatgcgtctggctttgcggctatccggcatacaacaccagtcccatgacgatcactgccacgaccatcaatattaaactgatgattaataagctgttggtatagggcaggtcctctttcaggcgcatcgctttttcattgcgtaaccagcgcaagtagccatacatcgctaacccgccggaaaacagacacaacaacaacgccagcagttcgcggatgacgggcgtggcgaaatctggcgcaagttgatcaagcccaacccccgccgccagaaatcctagtgcagtacggatccacgccagaaaagtacgctcattagccagcgagaagcggtaatcgggcgcttctccgaggcgggaaattttcattgttgctccttgtaaactgttcctcgccgaaaaattaggccaggaacagcaataatgcatcagaacttctgttttttctcttccaccttcaccccttgtgtcggtaaaccggtgtcatagtcgcgtaccactggagaataaccatcctgtgggcgtggacgaaacgcccccatccagcgcggttgtgcatctttgcgccacggacgcaggttccattgataactgcggaacggatcgcgaattttgtccatgtaatccaataaggcgtcatgcattttgctgcgaacgtcggcaaaatggatatcatcgatcaggttatgcatttcatttgggtcattacggcgatcgtaaagttcatcactggtgaagaggttgagcaccagtttaaagtcatccgttacccagcaacgcaccggaataaaaccgccaaagctgtcatgctcaatctcgtagcgattaaattccaccaacacgccacgtggttcttttacggcaaggatatttcccccggcagaatctctggtttttcaatatctgccagcgccatcattgtcggcagtaagtcaatatgactgactggcgtatcgacctgtcgccgctccccttgcggcgaacggatgatcagcggaatgcgggtgatgtcgtcatacatcgccgctcctttactgatcagcttatgtgcgcccatcatttcgccgtgatcggaggtataaataacccacgtattttcacgttgctctggcgttaaggcgttgatgacccgtccgatttggtcatcaacaaagtcattgcaggcaaaatagagcggatggtgataaagcccgtcatcaccgactggcgatggcatcgcctgcgcccataagcggtgatgttccggtttgttcgccaggtcatcctctgctttctcacccagttcgtagtaaaaatcagtgtatttctctaaatactccaccggacaggtgaacgggtgatgcggctcatcatacgaaatcaccatcaggaaaggttcgtcggcgcgcgcgggctgttgcagaaaatccaccgcccgattgctgatgcggtgcgcccaggtgaaggtttcgtcaatatggttcgcctgtaaatcctcaacgctgtttaggccattgcgccacaggctaatctctttctccgtcagttcactaagatagttcgcgccatcgaaccagtaatcagcgtcccactccggcggacactcgccagtgccgaaatagtcatgtccatcgagatgccatttgccgatgtagcaggtgtgatagcccgcatccttaaagtagcgccccatggtggaaatgtttttgcccggcgcgacgttgttggtccacgggccggactggttagcgtagataccggtgaatagtccggcccgtgcaggtgtacaaaccggtgaacaggtgtaggcagaattaaagcgaataccttctgccgccagactatcaatattttgcgtattcagcggcttaccgctatagcaaccgaccatattggtggcctgggtatcggtcatgatgaacagaaaattggggcgtttcataggctatccttcgcatcgggagtaaaggtgacggctgggtcgtgacgatgccgccagctgtcaaaaatcaggtagacaatcactacggcggcgatgaaataactgatcatcgctaaccagcgcgtaccgtagccaccgaattcagccagcccggcatagacgccaatcatcgcgaacaggataccaattgacgcaatcttgacgtttttccacggtttcatgtccaccgcaaacgcatctttgaaggtgaacggcgtggcgcgcggtttgataaaaccgatcaccagcatcacgaccacgttgatgcagaacgtacaggccagcacatagaggaaatggaagtcgaacttcaccagatagttgatggtgatgtagctgattatgccaatccccatcgccacttttgccgccagcgccggaatgcgcgggaagaaaaagcccataatgatgatggtaaccagcggcacgttgtaaataccgttgagctgtttcatccagctatacagcccctgcggcgcgttggcgatccacggcgcgaccatcaccgaaacgacggcgataaagaaaccaaatttgcgcccgacggtgaccagctgttgcggctcggcattctggttaatgatgcgccggtaaatacccatactgaataacgtactggcgctattcagaaagccgttgaaggtactgatcaccgcaccacataacaccgcaccgaagaagcccaccagtggcaccggcagaacgttattgaccagcgtcgggtaggccatgtcggctttcggtaaatcctgatacagatgaaacgcaatcaaccctggcagcaccagtaccagcgggtcgagcattttcagcaccgccgttaacagcgcccccttttgcccttccgccaggctttttgacgccagcgtgcgttgcacgatgccctgatttgtacaccagtaaaaggtgttcaccagaatcaaaccggtaaatgccgcgccaatcggcaagggatcggtcgggccgccgactgagtttaatttctcggcgtgaacggtggtgagttgctcaatgccctgcataaagctgcccttgcccatcgcgatcaggccaaataccggcaccatcaacccgccaataaccagcccaataccgttaatggagtccgccactgccattgcgcgcagtccgccgatcaccgcatacaaaattcccgccagaccaagcaaaatcaccagtaaccagatagccgcaccatcggaaagttgtagcgactcacccacatgaaacaggctgttgagcgccaacgcgccggaatagagaacaatcggcagaaagcagacgccggtggcaatgaggaagcagaagtcgatgataatacgcgtcgttttatcataacgttcctccagaaaatcggggatggtggcaatgccgcgcttcagatagcgcggtaaaaagattagcgcgaggaagatcagcgtcactgcagaggtgacttcccagcccatcaccgacatgccacttttgtaggcctgcccggaaaggccgaccagttgctccgtggaaaggttggttagcattaacgaagcggcaataaccggcgcttttagtgaacgtccggcaagaaaatagccttgttgcgatccggtatctgttttacggaccttccaccaggtgatgaccgctaccagcagcgtaaaaccgacaaaactcaagatttgtaacgaattcatctcatagcccttatttatgtttatgtcccggacgcatgaatatagggagaggtaaaatgcgtcgggtcaggcagtcagattcttaaaatacaaacgtcgtatccctgaacggattgttttctgttaagttcaggttgtgagcataattcgccggagggatattaaaatgaatggaaaattgcaaagttcggatgtaaaaaacgaaactccgtacaatattcccttattgattaacgaaaatgtgatctccagcggaatttctctgatatcgctctggcatacctacgccgacgagcattatcgggtgatctggccgcgggacaagaagaaaccgcttatcgccaactcatgggttgcggtgtataccgtacaaggatgtgggaaaattcttttaaagaatgacgaacaaataactctgcatggcaactgtattatatttttaaagccaatggatattcactcttatcactgtgaaggtttggtctgggaacagtactggatggaatttacccccaccagtatgatggatattcccgtcggtcagcaaagcgttatttataatggcgaagtttataatcaggaactcaccgaagttgctgagttaattacttcaccagaagcaataaaaaataatctggcagtcgcttttctgacgaaaattatttatcagtggatttgtcttatgcacacagtcggtaaaaaagatccacaacggcggcaaattgaaaaattaattgccactttacatgccaatctacaacaacgctggagcgtagctgatatggctgccacgatcccctgtagcgaggcctggttgcgtcgtctgtttttacgctataccggcaagacgccgaaagaatattacctcgatgcgcgtctggatctggcgctatcgctattaaagcaacaagggaactcggttggcgaagtcgctgatacgctcaacttcttcgactcctttcatttcagcaaagcctttaagcataaatttggttatgcgccgtcagctgtgctgaagaatacggacaggtaataaccagaatggcgagtgtgtaaatgactcgatgatgttcagaaataccaggcggagtaccatttacggcgactccaccgggaaaagagttaaccgatactccagaagagcaccgccagtaattggggtgtgataatgcgcaggaacatcactaacggatagacagtggcgtaagagagcgccgccgcaccgctggttggatgaagattattagcaaacgccagcgccggaggatcggtcatggaacctgccagcatcccgcacatggtcaggtaattcattttggctaacatccgcgccagaatgccaacagtaatcagcggaacggcggtgatcagggcaccataaccaatccagcttagcccttcgccatccaccagtgtatggataaaatcgccgccggatttcaggccaaccaccgagagaaagagcacaatgcctaactcgcgtagcgccaggttagcgcttggtggcataaaccagtacagcttgccgatactgccgatacgcccgaggatcaacgccataatcagcggaccgcccgccagcccgagtttcaacgccgccgggaacccaggcacaaagacgggaatagaacctaacaatacgccaagcccgataccaataaacactggcagcatctgaacctgttgcagtttttgctgcgcattccccagcacattggcaacggcatcaattgcggacggacgccccaccaggttgaggatatcgccgaactgcaggctgatatcgctacttgcaactaattcaacaccagcacggttcaggcgcgagataacaacgtcatagcgttctttaaagtgcaggtcgcgaatacgtttaccgagcacgttttcattggtgaccaccacacgcgcgacgcgcaaatcagtgcctttcgtagacagcgaggtatcgacctcctgaccaatcaccagttgcgcattatgtaaatccgcaggctgccccaccagatgcagcaaatcgcccagttgaataacggtttctggcgaaggcacttttagggtttcttctcgtttcaatcgtgagcaaataactttatcgccattgagaatcggcacatctttaatggctaaattatgcaaattaggattctcaactcggatgttaatcgtcctgattagcgcaccgccgttggttcgcgtggactcgtgctgctgggcctcagtctcaacattgacgcggaaaataacccgcagcatccacatagtgaacaaaatgccgcaaatcccaaatggatacgccatcgcatagctcatccccatttgatcgaccatcgccatcggtgtccccaggtcgcgcaagatctgctgccctgcccccagcgctggcgtattggtgaccgcgccggaaaaaatccccagcactaccggcagtggaatatcaaacagtttatgcaggatggcggtaaccagaccaccgatgatgacgatcagaacagcaaacaggttgaggcgtaatccggagacgcgcaatgaggcaaagaagcccggccctacctgaatcccgatggtataaacgaacaggatcaggccaaactcctgaataacatgcagcatatcgctacttaatgtcatccccgcctgagaaacaaaatggccgacgatgatcccaccgaacagcacgccgccaatgcccaatccaacaccgcgaaacttgacgttgccgataaacaacccgacgaccgccaccaaagccagaatactgaccgttaatgctatatcactcatcgtccatttctcttgaaataacattttaattgctacggattatggctgaatcggtgaagcagatttgccttatagcgcacattatcacgggaaagaacgtgccgaaatatcttaaacaggcgaaatttaacgcattgctgaagaaaaaagacaaaaaaaagccccaccagaatggcggggcaaagagaatagctagttagctatttaacgcgggacgttcgctgatagcgatacgctgcgctgcgatgggttcaggctcattacgaattaaatcaatatgcagtaaaccgtttacgaaggttgcgccagagacttccatattttcagccagcgtaaagctcaggctaaaaggctgattcataagcccttgatgcagccattttttctcttcttttggctgctctggcgtgccttttacgctcaggcgcgtaccttccagttgaatctctaaatcttcctgacggaaacctgccagcgcaagggtaatgcggtagtggttatcgtcgcttttctcaatgttgtacggcgggaagctctggctttcaccggcgttttgcagtgcgttggccagtttgtcaaaaccgatccattgacgcatcagtggggataaatcgaagttacgcatagtcatttctccttctaagaagcgagtaagtacctgcaaatccgaagattcgcatatgctccctgacggcgagcatgaaaatgtcagaccgcgccaggcggccttagggaattagttgatttcgatacggcgcggttttttcgcttccggaatcacgcgttcgagatcgatatacagcagaccattcaccaggttagcaccacgaacatgaatgttctcagctaactggaatttacgttcaaagttgcgttcagcgatgccctggtacagataggtgcgctctttttgttcgtcggcgtgagcacctttcaccaccagcagattatcctgggcggtaatttccagttcgctctcagcaaaaccagccacagcgatagcaatgcgataatggttttcgtctaccagttcaacgttatacggagggtagccgccattactctggctctggttgttttctaagtggttaaacaaacggtcaaatccaatagcagaacggtaaagcggggataaatcaaagttacgcataatcaatagctcctgaaatcagcgagaatctaagaccttccacaatggacaggtcaggtagccagaacacccatcaggcgcgtcctcatcggctacgatgtaaaaatgggtctggaaatgaacttttcaagccttatcagcggacttttttttgcagtttatggtctattgcatagactgagggggcagcacgaaacgttaaagtgcgatagccgccacagtgcgacgtaatgatgatgttattttcagcaagggatcgctataactcatcaggccaacacccacgatcaacagatgaatttattatgataagaaatgtgttgttagcgttcatgatatgcagcggaatgacattactcggaggatgctccagcgtgatgtcccataccggggggaaagaaggaacgtatcctggcacccgcgccagcgcaaccatgattggcgacgatgaaaccaactggggcacaaaatcgctggcgatactcgacatgccatttaccgcagtactggacacaatattactaccgtgggatgtgttccgcaaagacagctcagtgcgctcgcgcgttgaaaaaagcgaagccaacgcgcaagaaaccaataacgtcattccccccgccaaaatgcctgcaaactgagagctagcggtcagtttcggtgatccacaactgaccgtcctccatccacgccaaccattgaccatccggcgagaaaaccacggcgtccgcagaaggtggattggcgtggttttcggttaaatactcaacctcgccgctttgcgcatgggcacaagcaatccgattatccagcacaaatcccagccattcgcctgatggatgccagttaaatgcagactgaatatccgttttattatgggttaactggcgtggttcaccgccctgtggcgagataagccacagttgcacaatgccgttatcatcacgcattaaaaacgcaatttgtgttccttgaggattacaacgcacccagtggcgcggaatgttaaccaggcccgggtaaatacgatggtgcgtaaaggttaaacgtcgctgcacgacaccacgcggtggcgcaggcagggttgtttccgttccacttaacggcacatcacctgccgctttccagccagcttcatctttcggcaactcgacaataaacagctccggcactttctcgccctttggcgaaagtgtgtcgccaataaacgccagcgcgtgatttcctacccatccttcttcataagcacgattgatttcatcactgccaggctgtggcgtgggcgtggttttacttaccagcacgcaccagtggctaccgctgtattcacgcggatgctgcttttgtacgttgaccgggccaaacggtgcagcaacaccgacgtttcgcaaatccagcgccggatcgagttcatgcattacatggtcgttgtaggtaaagctcaccctttcaccgttcgggctaaagacatgtacatggctgccgccacgtagcgctcctggcgtatatggcgcggtaatatccattgcatcgagattgctcaccttgccgctttcaacaatcactccgcgccgatgatgaaagtcgtaataccatgtttcatcaggattttccgggccgtggatgaagacatacttctctgacttcggatgaacggtcaccacgccgacgtatgcgccctgtgacgcgcgatagataacctcgacctcgccggtatggatattcacacgctcaatggtctcgccggtaaacgacgccccagaaggccgcacgtcaaacaccagccactggctgtcgggcgtccaggtattggtattggtgagcaggtgattacgaggagcaaaggttatctgtttcatggcgcggtcctgatacaaaacggttcccgccataatacttcacaaggacttcactttcagacaatagtcttttgccatcgtgatgaatgtgagtgaaaagatggaacatttcgacgtggcgattattggcctcggcccggcagggtcggcgttggcgcgaaagttagcaggcaaaatgcaggtgatcgcgctggataaaaagcaccagcatggtactgaaggtttcagcaaaccttgtggcggtctgctggcaccggacgcgcagcgatcttttattcgcgatggattgacgcttcctgtcgatgtcatcgccaacccgcagattttcagcgtcaaaaccgtcgacgtcgccgcatcgctcacgcgtaactaccagcgaagctatatcaatattaatcgccatgctttcgacttgtggatgaaatcgctgatccccgccagcgttgaggtttaccacgacagcctgtgtcgaaaaatctggcgtgaggatgataaatggcatgtcatttttcgcgcagacggctgggagcagcatattaccgcccgctatctggtcggtgccgatggtgccaactcgatggtgcggcgacatctctacccggatcatcagattcgtaaatatgtcgccatccagcagtggttcgcagagaaacatccggtgccgttctactcctgcatctttgataatgcgataactgactgttactcatggagtatcagcaaagacggttattttatctttggcggtgcctatccgatgaaagacggtcagacgcgtttcacgacgctaaaagagaaaatgagcgcctttcagttccagtttggtaaggcggtgaaaagcgaaaaatgcacggtgctgtttccctcacgctggcaggattttgtctgcggcaaggacaacgcctttctgattggcgaagcggcgggatttatcagcgccagctcgctggaggggattagctatgcgctggatagcgcagagattctgcgttcggtattactgaagctgccagagaagctcaataccgcttactggcgcgccactcgcaaactgcgtttaaaactcttcggcaagatagtaaaaagccgatgcctgaccgcaccggctttaagaaagtggattatgcgcagtggagtggcgcatattccacagttgaaagattatccaacgcgcttcacatcgcccaccagcaggatgtaagagagcgcgccaatcaacgcgacggcggagatataaaccagtgcaggcgcgaaaccgtaaccctgcgccaggtaccccaccaccagcggaacggtgatgccgcccagaccaccggcaaagttaaacacaccgccggttaaaccaatcaggcgcatcggtgccagagaagagaccagcgaccaggttatcgaagcaaaaccgttgccgaagaatgccagcgccatcaggcacataatcatcatcggatcgttggtgtagttcgcacccataatgcaggtggagatcagcaagccgcagataatcggcgttttacgcgcaaagcccagtgaaaagcccttacgtaccagcagatccgcgacccagccagagagcaggacgccaataaacgccgcgaggaatggcaccgtggtcataaagcctgctttcagcgctgtgattcctttttcctgggttaaatagttcgggaaccaggttaagaaaaaccacagtgtagaagccaccgcaaattgcccaagatagacaccgatcagtttacgatggaacaccagtttccagtctttggctgttaacggctgacgcgcctctttcttcaccggcgcatcgccatccaccagaccgccgccatcacgaatgtaatccagttcagctttgctgatgcctttggtcagacgcggcggctgataaaccttaaaccaaatcagcgaccagataatgccgataccaccggtgacaatgaacacccagtgccagctcaacatctcctgaatccagatcagcagcggagtcagaaacgccagaccgacaaactgaccagacgtataaaaaccaacggcagaagcacgttcatgttccgggaaccaactggttaccatccggttattggtcgggaacgcgggcgcttcgaaaataccggttatcgcgcgcagaccaattaatgacattaagcccgtggcaaagccctggaataacgtcgccactgaccagccaaatatcgcaataaaataagtcacgcgtgaacctacgcgatctaaaaaccaaccaccggggatctgacatagcgtataaagccaggcgaaggccgaaaatacatagcccatttgcgctttagtaataccaaactcttcctgaatatgggcagaagccacggccaggttagcgcggtcaacataacaaatgaccaccgtaataaagatcatcaccagcgtcagataacgccgacgccccggctttgctgcattaacgggaatatccatagcgagctttctccagattttgggcatagcgaagccgctcaccatgccctgtaatttacagagggttatatttttgtattgctgttttagtgcccgatgaggggcttacgtggcaggaattaccactctgctacgctgttatcttcatgacgccagagcggattacgccagtccggggcatttttactgaactcaataactttagcttcgtcgatttccacgcctaagcccggtttcgttaatggtttaaagaaaccgccgaccatgctgaagtcctctttgtttttcacaaagtcgagtaactccgcgcctttgttgtaatgaatgcccatactttgttcctgaaggacggcgttataggaaacaaagtcgatatgcaggcaagccgccagtgcaatcggtccgagcggacagtgcggcgcaagggtcacgtcataggcttctgccattccggcaattttgtagcattcggtaataccgcctgcgtgggagagatccggttgcagaatcgaaataccgcctgcctccagcacacgtttaaaatcgaagcgtgagaacatgcgctcacccgccgccagtggaatatgcgtttgtgccgccagtttcgggtagtattcggcctgttccgccagcaccggctcttcaataaacagcggacgatacggttccagctctttaatcagcactttcgccatcggcgcgctgacgcgaccatggaagtccagaccaaactcaatctgattaccaaaggcttcacgaatttgcgccacggtgttgactgccgcatctaccgcgcgggagttatcaattagccccagttcttcacaaccattcagtttgaaggtatcgaagccgatttcgcgtagcgttttaatgccgtcgataacatccgccggacgatcgccgccgacccaactgtaggctttaattttgtcgcgaaccaggccgcccatcagttgccagaccggcgcattcagcactttgcctttgatatcccataacgcctggtcgatcccggcgatggcgctcatcaggattggaccgccacgataaaatccggcgcgatacatcacttgccataagtcgttgatgcgtgacgggtcctgaccaatcaaatagtcactcagctcgtggactgccgcttccaccgtgcgagcgcggccttcaatcacgggctcgccccaaccgaccacgccttcatcggtttcaattttcaggaacatccagcggggaggtaaacgatacgtggtaattttggtgattttcattgcactgcctctcgatacgccttaacaaatgctgctgcctgctgcgcagtccgttctacggactgcccggcgcgatagagatcgctacctaagcccgctccggcacagcctgcatctatccactgcgccaggttttctggcgtcacaccgccaacggcaaagaccgcgatgtccggtggtaataccgcttttaatgctttgatgtattgcggaccaaaagccgatgacgggaatattttcagcgcctgcgcgcccgcttcgagcgcggtaaaggcttcggtcgccgtcgcacagccggggcagacggtcatgccgtagcccaccgcacggcggatcacttcactatggatattgggcgtaacgatgagctgacagcccattctggcgagcgcatcgacctgttcaggtttcagtaccgtacctgcgccaatcaacgccttatcgccgtacgcatcaacgatggcgggaatgctctgctcccattgtggagaattcagcgggatttcaaccgcgtcgaacccggcgtcaatcaccgcgccaacatgtgccagtgcctcgtcgggcgtaatgccgcgcaaaatggcgatcagcgggagtttagtttgccactgcatgagcgatgctccttataccagcctgaaatgccgtgtcgcctgccaccgccgtcacgtcgcaacccatcgcctgaaaggcttgctggtagcgcacggtcagcgatgttccggcgacaagggtgatgacttgttgatgggtcacatagtcgcgcatactggcgacctctgcgccaatcaacaaaccagagagaaattcgctgacctgttcgcggggaagtgttcccagcacatgcgaggcgcgaacttcaaaaagctgcggcaatatgtcgggagcattaaggccacgctcaagaccagccgcgaaagcatcggcagcgttttcctgcggcggcaaacctgcgccaatcaatgagtgatttaacagtaaatgatgtaattcaccggtcatcacggtgcgaaaatcgttaatttgctggctatcggcctgcacccatttgcaatgcgtaccgggcatgacataaagagaggaaggagcgagagtgcgcgcgccgatcaattgtgtttcttcgccgcgcatcacattgtggttatcgtcatgagagacgcataatccgggaataatccagatattgtcgccagcagatgttaattgttcgccaatagacgagaaacgggctggaacggataaatatggcgcaactttccagccgacattgctgccgaccattcctgccattaccactggcgtattctcttcacgccagtcggtcgtcacttctgctaacaccgcagccggagattttccgttcaggcgcgtgacgcctgcttctgattgcctgctgtccaggcagtggtcgccctgataaagccaggcgcgcagattggtcgatccccagtcaattgcgatgtagcgagctgtcatgtgatttcctttaaccttcgtgtcgagctggcgatcatggtaagcgccgcctgctctgccgcatcgccgtcctgatgccttatcgcatcgaacagcgccttatgttcctggagcgtttgcggcatgttggcctcatcgcccatccaggttcgttcaaaaaccgcccgctgcagcgaactgatcgcaatgctcagttgctgtaacaccgggttatgcaccgactgcagcaccgcctcgtggtagcgaatatccgcttcgttaaacgcttcgcggtcctgattgttagcaatcatctcgttcagcgccgattcaatctgcgccagatcgctggaggtcgcgcgttctgctgcccaacgggcaatcgccggttccaccagatttcgcacttcgctcattgcactgataagccgtgggtcgtagtcgttttccagcacccattgcagtacgtcagtgtcgaggtaattccactggttacgcggagccacaaacgccccgcgataacgtttcatttcaatcagccgcttcgccatcagcgaacgaaatacctcacggatgatgttgcgcgaggttgcaaactcctcacagagttctgcctcagccggaagcggcgagcctggcacgtatttgccgtgaacgatctgtttacccagcgtaataacgatgcgatcggttttattgagagtcatggagagtccttgtgctctgtatgttcttctctactttaccccgatcgatgcataacgcggcaattttgtagtaccagcgtgatgacgttcgcgtttgctgtgcgcctaatgtagtacaaagttatattattgtactacaatttagatcacaaaaagaacaatccataagaaaatgttctacgtcgggcaaaaatctgaaaagggagatcaggcgctaaacaggagggaaagaagagtatgctttcaacggcttagtactcttgtttaaaggattaatcatgaagttgaatcttaagggatttttcaaggctgccagtttgtgttctttggcatttgcgttgaccggatgtatcacctggggattggtttccaatactgcaagccgtccacatgccgagcaatggcggtcagacacgattaagggtttatcgctggcagaagatagtaacggtacgaaaggctatgtttttgttggtgaatcgttggactatctgttgaccaccggcggcgatgaggtggttaaaatgctgaacgatccggcaatccatggtgaaagaatcaccgtttctgataacgcgaaatttattttaagcagcagtaataagaatttctctggtgctattacgctctattacgactggaacaacgaagaagataaggcactggcaacacaatatggttttatttgtgatacccggcgttgtacatggatgctggacggtttgaaaggctcaatccaccagaaaaataaaaaagcggattactcaaacgtgatggttttccatcaaccctttacggtgggattttatgagtacaaagcaacagatggcgtcccgcacggcctcgttaatgcgctgctgccagtcactcttacgctggatatagtaacgtcaccactccagttcctgattttatgcacgaccagaaattgttaatcgctgcgggcaaacgcattcatgccgtttgcccgttcactgattaattcagcacatacttctcaatagcaaatgccacgccatcttcaaggttagatttggtgacaaagttcgccacttctttcaccgaaggaatagcgttatccatcgccacaccgacgcctgcatattcaatcattgcgatgtcgttttcctgatcgccaatcgccatgatttcttccggtttaatacctaacacgtcggccagtgatttcacacccgtacctttgttaacgcgtttatcgaggatttcgaggaagtacggcgcacttttcagcacggtgtatttttctttcacttcctgcggaatacgcgcaatggcctggtcgaggatggcgggttcatcaatcatcatcactttcaggaactgggtattggggtccattttctccgcttcgcagaacaccagcggaatggtggcaacgaaagattcatgcaccgtgtagtagctgatatcacgattggcggtgtacagcgtggtgcggtccagcgcgtggaaatgagaaccgacttcgcgagagagtttttccaggaaacggtagtcgtcatagctgagagcggtttgcgccacggtgctaccatcagcggccttctgtaccagcgcgccgttataagtaatgcagtagtcgcccggctgttccatatgcagctctttcaggtaattgtgaacacctgcataagggcgacccgtcgttagcacgacattcacgccacgggcgcgagctgcggcaatcgcatttttaacggcaggtgaaatggtgtgatcgggcagcagaagggtgccatccatatcgatagcaatgagtttgatagccatgagttccccaggtagattggttcctgacccatgctaacgcgattccgctcaaaaatcagtacaacacccgagggaaaagggggatgcaacgcgcattgcgtgctccccttttgcttagcggaaaagtttccctttcagcagttccatgcctgcggaaagcagatcgttatgggcttgtggtgacacttcaccttgcggtgagagcgcatcaataatcttcggcaattgttctgccagtaaactggaagctgtactggtatccacgccaagtttttgcccgagatcggacaccgcatttgtgccgagcgccgattccacttgctcgccgctaactgattgattgctctgttgattactcagccaggttgagagaatggcccctaagccgccactttgcagtttttccaacagcacttgaatgccgccctgttcctcaacccagctcaaaatggcctgatatttccccgcatcgcctttcagaaaggcaccgacaacgtcatcaaaaagccccatgataatcacctgtaaagcgttacgtgttgacccaaaaagtatagatctgcgggatgataattgcggattgcagaaataaaaagggcggagatgatctccgcccttttcttatagcttcttgccggatgcggcgtgaacgccttatccggcctacaaaaacatgcaaattcaatatattgcaggagtctcgtaggcctgataagcgtagcgcatcaggcacgctcgcattgttaacgccattaaatatcgatattcgccgctttcagagcgttctcttcaataaacgcacggcgcggttcaacggcgtcgcccataagcgtagtgaacaactggtcggcagcaatcgcatctttaacggtaacgcgcagcatacgacggctttccgggtccatggtggtttcccacagctgttccgggttcatctcgcccagacctttataacgctggatggagaggccgcgacgggactctttcaccagccagtccagcgcctgctcgaagctggctaccggctgacgacgttcgccacgttcgataaatgcatcttcttccagcaagccacgcagtttctcacccagcgtgcagatacgacgatattcgccgccagtgataaattcgtgatccagcggatagtcagtatccacaccgtgggtacgcacgcgaacaatcggctcgaacaggttttgttcggcattggtatggacatcaaacttccactggctgccgtgctgttctttgtcgttcagttcgctgaccagcgcgttcacccagcgggtaacggtctgctcatcagagagatcggcttccgtcagcgtcggctgatagataagctctttcagcattgctttcggataacgacgctccatgcggttgatcattttctgcgtcgcgttgtactcagacaccagtttctctaacgcttcgccagccagcgccggtgcactggcgttggtgtgcagcgttgcgccatccagcgcgatagagatctggtactgatccatcgcttcgtcgtctttaatgtactgttcctgcttacctttcttcactttgtacagcggcggctgagcgatgtagacgtgaccacgttcaacgatttccggcatctgacgatagaagaaggtcaacagcagcgtacgaatgtgcgagccgtcgacgtccgcatcggtcatgatgatgatgctgtgataacgcagtttgtccgggttgtactcgtcacgaccgataccacaaccaagcgcggtgataagcgtcgccacttcctgagaagagagcatcttatcgaagcgcgctttctcgacgttgaggattttacccttcagcggcagaatcgcctggttcttgcggttacgcccctgcttcgcagagccgcccgcggagtccccttccacaaggtacagttcggaaagcgccggatcgcgttcctggcagtctgccagtttgcccggcaggccagctaagtcgagcgcacctttacggcgggtcatttcacgcgcgcgacgcgcagcttcacgggcacgggcagcatcgataattttgccgaccacgattttcgcgtcggttgggttttccagcaggtattccgccagcagttcgttcatctgctgttcaaccgccgatttcacctcagaagaaaccagtttgtctttggtctgtgaggagaatttcgggtccggcactttcacggaaacgaccgcaatcaggccttcacgcgcatcgtcaccggtggcgctgactttggcttttttgctgtagccttctttgtccatgtaggcgttcagagtacgggtcatcgccgcacggaaacctgccaggtgagtaccgccgtcacgctgcggaatgttgttggtaaagcagtagatgttttcctggaagccatcgttccactgcaacgccacttcgacgccaataccgtctttttcggtggagaagtagaagatattcgggtggatcggcgttttgttcttgttcagatattcaacgaacgccttgatgccgccttcatagtggaagtggtcttctttgccgtcgcgcttgtcgcgcagacgaatggaaacgccggagttgaggaacgacaactcacgcagacgtttcgccagaatgtcatattcgaactcggtcacattggtgaaggtttcaaggcttggccagaaacgcaccatagtgccggttttttcagtctcgccggtaaccgccagcggggcctgcggtacaccgtgttcgtagatctgacggtgaattttaccctcgcgctggataaccagctccagtttttgcgacagggcgtttactaccgaaacaccaacgccgtgcagaccgccggacactttataggagttatcgtcaaatttaccgcctgcgtgcagaacggtcatgatcacttccgccgccgatacgccctcttccgggtgaataccggtcggaatgccgcgcccatcatcctgtacggagacagagttatcggcgtgaatggtgacgataatttctttacagtgacccgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttatacttgggttaatccgttattttacccttttccacggtaaacatcttcgaattttcgtccgacatgtctataacgtgttcagcactgatcgcgctgacaaagacctgtgattgcgtcgcttttaagcggctggcaagcagcccgcgacgctcatcatcaagctcagaggcaaaatcatctatcaggtagagacaccgccgcccgctttcacgggtgaggaactctccttgcgccagacgtaaggcgcacatcagcagcttaagctgcccacgcgataaggtatcttccaccggcgcaccgtcggcgcgaatgcgtaagtccgctttatgcgggccatgcgcggtgtaggttagctggcgatcgcgttcaaaattacgttccagcacctcagcatattctgtctctttctcccagccgcgctggaaagagaaagtcagagaaaactcagggagaaattgcttacaggtatcggccatatcagccgcgataccggcgctatactccgcgcgccaggtgctgatttgctccgccagcgggatcagttctttatcccacgggcgtagctgttcgtaacgagtcacctggcgcagcgccgcattgcgctgcttgagcaatcgcttgagattgctccaggcggtgaaaaatccgggttcgttgtgaaagcatccccagtcgaggaatgctcttctgtatttggggccgccgttgagtaaagtaaacccttctggcgttatcagctgcattggcatcaggtgcgccagctccgcgactttatgcccgtctgtaccgtcaatacggactttgctgtcgccttgtttgtctttggttaaaccaatcgccgtctcgcgctcttcgccctgtaatcgcccgtggagaacaaacgcctcctgctcgtggcgaatgacgcgaccaatctgcaaactgcgaaacgcccgaccgtggccgagcgtatagatggcttccagcacgctggttttgccactgccgttggcacctaccagaaagttaaagccgggagataaggcgagatccgcggtttcaatgttgcggaaatcgcggatcaacaagcgggtgagggacattacagtctcattggcatgacaacataagccgcgctctggctggccgcatcttcaatctgcacgctggaaaccgaatnnnnncattccattcattaattaattaatgaatgaatgnnnnntccatctccgcaccgctataggtaacgtcgaggatctcttccgcttcttcctgttctgggttgttggcggtgattttcagctggttttcgctgacatacagacgcacgccgcggaatttctcgttagagagaattgccgcacgagcaaacgcctgcttgagcagatcacagccagcttccagatgtttgtccgggttcttcggcagaacgcgacggtaatccgggaagcgaccatccaccagtttcgaggtgaaaataaagtcgccaacgtgggcgcgaatgttgttgctgccaatctgcacgcgcagcggattgtcgccgccgtcgagcatacgcatcagttcaatcacgcctttacgcggcacgatcaccgaatggcttggcaaagattgaccaattggcattgaacagactgccagacggtggccgtcggtcgccacggtgcgcagttcttcaccttcggtttcaaacagcataccgtttaagtaatagcgaacgtcctgatgcgccatagaaaactgggtcgcttcaatcagacgcttcatcgtcgcctgcggcagggtaaattcgacttcgctctgccagtcatcgaggttcgggaaatctgccgctggcagggtagacagcgaaaaacggctacgcccggagcgcaccagcatccgctcaccttccagctgcacggcaatttccgcgccttcaggcagaccacggcagatatcaaagaatttgcgcgccggaacggtcgtcgcccctggttcgtgcggctgaaccagcgcaacgcgtgccaccatttccatctcgagatcagtaccggtcagcgacaacgtaccgtcagcaacctgtaacagcagattaccgagaatcggtagcgtaggacgaccacctaacggaccgctcacctgttgtagcggttttaataaatgctcacgttctacggtaaatttcataggtttacgatgacaatgttctgattaaattagaaaaatcttctttgatatcgtggctctcttcacgcaactgctcgatcttccggcaggcatgaagcaccgtcgtgtggtcacgaccaccaaaggcatcgccaatctccggaagactgtggttagtcagctctttcgccagcgccatcgccatctggcgcggacgggccaccgagcgggatcgacgcttggaaaggagatccgcgactttgatcttgtagtactccgccaccgtcttctgaatattgtcgatggtgaccagtttttcctgcaatgccagcaagtcacgcagcgcctcacgcacgaagtcgatggtgatcgcccgtccggtaaagttggcgttggcaatgacgcggttcagcgcgccttccaactcacgtacgttagatcgtagacgcttggcgataaagaacgccacttcgcccggcaaacgaatgtcgttttcgtcggcctttttcatcaggatcgccacgcgggtttccagctctggcggttcgatcgccacagtcagtccccagccgaagcgggatttcaaacgatcctcaacgccgttgatctctttcggatagcgatcggaggtgagaatgatctgttgattaccttccagcagggcgttgaaggtgtggaaaaactcttcctgagatcgttctttattagcaaaaaactgaatatcgtcgatcagcagtgcatctacggaacggtagtagcgtttaaactcttcgatcgcgttgttttgcagggctttaaccatgtcctgaacaaagcgctcggagtgcatataaaccactttggcattcggcttgcgcgccataatgccgttacccaccgcatgcagcaggtgagttttacccaaacccgtgccgccataaaggaacaacgggttataagcaccgccagggttatctgccacctggcgagccgccgcgcgcgccagttggttagatttaccttcaacgaagttatcaaacgtgtgtttgacgtttacgttagaacgataggtcggttctgccggagccgggacgttatcccaacccgagcgcgtagaaggcgcagcacgttgcggctgcgtttgcgccacctgtgcaggggccgcgacgttgctcgtcactgccgcttgtggcgtttgcgtcaccggtttggtgccgacttcaaaacgcagctgtggggcatccgctccgcagaaactggttagcagtccattgatattattaaggtacttgtcccgtacccaatcgaggacaaaacggtttggcgcgtacagggccagcgtgttatcgctcagttccgcctgcaatgggcgtatccacatactgaattctgtggctggtaactcatcctgcaatcgggcaagacactgctgccaaagcgaaagtgacacggcggactccactcgaacaaaagtcgataatgactaaggctgaaacattcatgattgttgacgtacgtcgaaaagaccctgcatgagggtgacgcacgaaccgctgtctgcggttatatgcccgatcaagatcctgcaaaacgatcgggaccgcggatcatagcctaaactgcgcaagagatcttctgtttctcacagattttcccgatttatccacaggatgatccagaactcgctaagtgtaaacgatcctgccgcgggccgggcacgatttacgccgcatattggaaaatttaatgaccatagacaaaaattggcttaatcgatctaataaagatccagaacgatccttgcgctttacccgtcagcccgtataatcctccacccggcgcgccatgctggtttacactggtgtgaggccgtacgttttccccgcgaaaaggtgcggaaaagcgcggtaaataaggaaagagaattgactccggagtgtacaattattacaatccggcctctttaatcacccatggcttcggtgtccatcgtttcatttttcggcggatatccaataaagccattgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaataaagctaacccctgagtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgcggtggtgatgttgagcaagccctgctgcctgcttacccgaaagagctgaactctacccagccgttccagctgctggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctccacctttggtcagttgaagcaatccatcactctgccaccgcatctcgataccggaagcagcaacttcgcactgcacaccttccgtggtgcggcgtactccacgcctgacgagaagtacgagaaatacaagttcgataccattgccgataacgaaaacctgaacatctcttcgaaaggtggttgggtggcaatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaattcaggacaaaatggcagctgttgctccgcacctggatctgaccgttgattacggttggttgtggttcatttctcagccgctgttcaaactgctgaaatggatccatagctttgtgggtaactggggcttctccattatcatcatcacctttatcgttcgtggcatcatgtacccgctgaccaaagcgcagtacacctccatggcgaagatgcgtatgctgcagccgaagattcaggcaatgcgtgagcgtctgggcgatgacaaacagcgcataagccaggaaatgatggcgctgtacaaagctgagaaggttaacccgctgggcggctgcttcccgctgctgatccagatgccaatcttcctggcgttgtactacatgctgatgggttccgttgaactacgtcaggcaccgtttgcactgtggatccacgacctgtctgcacaggacccgtactacatcctgccgatcctgatgggcgtaacgatgttcttcattcagaagatgtcgccgaccactgtgaccgacccgatgcagcagaagatcatgacctttatgccggtcatcttcactgtgttcttcctgtggttcccgtcaggtctggtgctgtactatatcgtcagcaacctggtaaccattattcagcagcagctgatttaccgtggtctggaaaaacgtggcctgcatagccgcgagaagaaaaaatcctgattcggtgagttttcgctaaaataagggcggtcagttgaccgccttttttcttttcgtagggcggataagcaccgcacatccgccacacaaagcaacaggaacatcatgagcgataatgacactatcgtagcccaggccacgcctccgggacgtggcggcgttggcatcctgcgcatctccggcctcaaagcccgtgaagttgccgaaaccgtgctgggtaaactgcctaagccacgctacgccgattatcttccgtttaaagacgccgatggcagcgtgctcgatcaggggattgcgctatggttccctggcccgaactcgttcaccggcgaagatgtgctggaactgcaaggtcatggcggtccggtgatcctcgacctgctgttaaaacgcattctgaccattcccggcctgcggattgcccgccctggtgagttttccgaacgcgcatttctgaacgataaactcgacttagcccaggccgaggcgattgcggatcttatcgacgccagctcggaacaggcggcccgttcggcgctaaactcgctgcaaggcgcgttctccgcacgggtcaaccatctggtggaagccctcacccacttgcgcatttacgtcgaagcggcaattgatttcccggatgaagagatcgatttcctctccgacggcaaaattgaagcccagctcaataacgtaattgccgatctcgacgcggtacgcgccgaagctcgtcagggtagtttgttgcgcgaagggatgaaagtggtgattgccggacgtcctaacgccggtaaatcgagcctgctgaacgcgctggcgggccgtgaagcagcaatcgtaaccgatatcgccggaaccacgcgtgacgtgctgcgtgagcatatccacattgacggaatgccgttgcatatcatcgataccgccgggctacgtgaagccagtgacgaagttgaacgtattggtatcgagcgcgcatggcaggaaattgaacaggcagaccgcgtgctgtttatggtcgatggcaccacgacagacgccgttgatccggcagagatctggccggaattcatcgcccgtctgccagcgaaactgccgatcaccgtggtgcgcaataaagccgatatcaccggcgaaacgttggggatgagcgaagtgaacggtcatgcgttaattcgtctttcggcgcggactggcgaaggcgtggatgtactgcgtaaccatctcaaacagagcatgggctttgacaccaatatggaaggcggcttcctggcgcgtcgtcgtcacctacaggcgctggaacaggcggcagagcatttgcagcaaggtaaagcgcaactgttaggtgcctgggcgggtgaactgctggcggaagagttgcgcctggcgcagcagaacttaagcgagatcaccggggaatttacttcagacgacctactggggcggattttctccagcttctgtatcggtaagtaaccgcgcttgcgaagccgcattctgactgtcagatgcggcttcgcttcattgttagcactcctgttattcctcaacccttttttaaacattaaaattcttacgtaatttataatctttaaaaaagatatttaatattgcgtcccgaacgattgtgattcgattcacatttaaacaatttcagaatagacaaattccttgagtattatactgtagcctcgtgtctttcgaggataagtgcattatgaatatcttacatatatgtgtgacctcaaaatggtttaatattgacaacaagattgtcgatcaccgcccttgatttgcccttctgtagccatcaccagagccaaaccgattagattcaatgtgatctatttgtttgctatatcttaattttgccttttacaaaggccatctctcgtttatttgcttgttttagtaaatgatggtacttgcatatatatctggcgaattaatgaatattgcaaatgtaatattcacagggatcactgtaattaaaataaatgaaggattatgtaatggaaaactttaaacatctccctgaaccgttccgcattcgtgttattgagccagtaaaacgtaccactcgcgcttatcgtgaagaggcaattattaaatccggtatgaacccgttcttgctggatagcgaagatgtgtttatcgatttactgaccgacagcggcaccggggcggtgacgcagagtatgcaggccgcgatgatgcgtggcgacgaagcctacagcggcagccgcagctactacgcgttagccgagtcagtgaaaaatatctttggttatcaatacactattccgactcaccagggccgtggtgcagagcaaatctatattccggtactgattaaaaaacgcgagcaggaaaaaggcctggatcgcagcaaaatggtggcgttctctaactatttctttgataccacgcagggccatagccagattaacggctgtaccgtgcgtaacgtctatatcaaagaagccttcgatactggcgtgcgttacgactttaaaggcaactttgaccttgagggattagaacgcggtattgaagaagttggcccgaataacgtgccgtatatcgttgcaaccatcaccagtaactccgcaggtggtcagccggtttcactggcaaacttaaaagcgatgtacagcatcgcgaagaaatacgatattccggtggtcatggactccgcacgctttgccgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcctgctgtgcatgaaagacgacagcttctttgatgtgtataccgaatgcagaaccctttgcgtggtgcaggaaggcttcccgacatatggcggcctggaaggcggcgctatggagcgtctggcggtaggtctgtatgacggcatgaatctggactggctggcttatcgtatcgcgcaggtgcagtatctggtcgatggtctggaagagattggcgttgtctgtcagcaggcgggcggtcacgcggcattcgttgatgcaggtaaactgttgccgcatatcccggcagatcagttcccggcacaggcgctggcctgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaagggttaacctttacctacgaaccgaaagtattgcgtcacttcaccgcaaaactgaaagaagtttaattaaaacactcagagtggctataaggatgttagccactctattaccctacatcctcaataacaaaaatagccttcctctaaaggtggcatcatgactgatcaatcagaaaaaaaacactctgcattttggggtgttatggttatagccggtacagtaattggcggtgggatgtttgctttacctgttgaccttgccggagcctggtttttttggggcgcttttattcttattatcgcctggttttcaatgttacattcagggctattattattagaagcaaacttaaattatcccgtcggatccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcactgccattttcgttgccagcgtattgtggataagttcgttagccgccagtcgtattacctcattgttccttgggctgaagattatctcctttgtaattgtttttggttctttcttcttccaggtcgattactccattctgcgcgattccaccagcaccactgcggggacgtcttacttcccgtatatctttatggctttgccggtgtgtctggcgtcatttggtttccacggcaatattcccagcctgattatttgctatggaaaacgcaaagacaaactaatcaaaagcgtggttttcggttcgctgctggcgctggtgatttatctcttctggctctattgcacgatggggaatatcccgcgagaaagctttaaggcgataatctcctcaggcggcaacgttgattcgctggtgaaatcgttcctcggcaccaaacagcacgggattatcgagttttgcctgctggtgttctccaacttagctgttgccagctcgttttttggtgtcacgctgggattgttcgattatctggcggatctgtttaagattgataactcccacgccgggcgtttcaaaaccgtgctgttaaccttcctgccacctgctttgttgtatctgatcttcccgaacggcttcatttacgggatcggcggtgccggactgtgtgccaccatctgggcggtaataattcctgctgtactggcaatcaaagcccgcaagaagtttcccaatcagatgttcacggtctggggcggcaatcttattccggcgattgtcattctctttggcataaccgtaattttatgctggttcggtaacgtctttaacgtgttacctaaatttggctaaatccttcaggaagccagccattcgctggcttcttgcctgtcaggaaatcacttatgtccaaatggcaactcgcctgattctccttcaccacgtatgctttgcgtcaccttactatcaggacgctttagcccatgtcccgctttttgatttgtagttttgccctggttttactttatcccgcagggattgatatgtacctcgttggtttaccgcgcatcgccgccgatctcaatgccagcgaagcgcagttgcatattgcgttctccgtttatctggcggggatggcggctgcgatgttatttgccggtaaagtggccgatcgttcagggagaaagcctgtcgccatacccggcgcggcgctatttattatcgcctcggtgttctgttcactggctgaaaccagcgcgttatttcttgcagggcgatttctacagggactgggcgcgggctgttgttacgtagtggcgttcgccattttgcgcgacacgctggatgatcgacgtcgggctaaagtgctgtcgttactcaacggcattacctgcatcattccggtgttagcgccggtgctcggacacctgattatgcttaaattcccttggcagagtctgttctggacgatggcaacgatgggcatcgcgttactgatgttgtctttgtttattttaaaagaaacgcgccctgcggcccccacaacttcggacaaaccacgagaaaatagcgagtcactgcttaatcggtttttcctcagccgtgttgttatcaccaccctcagcgtttcggtgatcctcaccttcgtcaacacgtcgccagtattgctgatggaaatcatgggttttgagcgcggagaatacgccaccattatggcgttgaccgctggcgtcagcatgaccgtttcattctccacgccgtttgcgctgggaatttttaagccacgtacgttgatgatcacctcacaggtgttattcctggcggcggggatcacccttgccgtttcaccttcccatgcggtttcgctgtttggtatcacgctgatttgcgccggtttctcggtaggttttggtgtggcgatgagtcaggcgttagggccgttttcattacgcgcgggcgtagccagctcgaccttaggtattgcgcaagtttgcggttcgtcactgtggatttggctggcggcggtggttggtatcggcgcatggaatatgctgatcgggattctgattgcctgtagcatagtgagcctgttgctgattatgttcgtcgcgcctggacgccccgttgccgctcatgaagaaatccatcaccacgcttgatctcaatctgctgctctgtctgcaactgctgatgcaggagcgcagcgtgaccaaagcggcgaagcggatgaacgtgaccccttcggcggtgagtaagtcgctggcaaagttaagagcgtggtttgacgacccgctctttgtgaactcaccgctgggcctgtctcccacaccgctaatggtcagcatggagcaaaatctggcggaatggatgcaaatgagcaatcagttgctggacaaaccactccacgaaacgccgcgcggtcttaagttcgaactggcggcggaatcgccgctgatgatgatcatgcttaatgcgctgtcgaaacggatctaccaacgatacccgcaggcgaccatcaaattacgtaactgggattacgattccttagatgccattactcgtggtgaagtggatattggtttttccggtcgcgaaagtcatccccgttcgcgggagctgttaagctcgctaccgttagccattgattatgaagtgctgtttagtgatgtgccctgcgtctggttacgcaaagatcatccggcactgcatgaagcatggaatctggacacctttttacgttatccgcatatcagcatttgctgggaacagagcgatacctgggcgctggacaatgtgttacaggagctggggcgcgaacgcacgattgctatgagcctgccggaattcgagcagtcactgtttatggcagcacagcccgacaatctgctactggcgaccgcgccgcgctactgccagtactacaatcaactccaccaactgccgttggttgctcttcctctcccgtttgatgaaagccagcaaaaaaagctggaagtcccttttacccttctgtggcataaacggaacagccgtaatccgaagatcgtctggttacgggaaaccattaaaaatctttacgcgtcgatggcataaccgaatcgtatgaaacgcgacccaatttcacaatgaaatgtaaaaaagttgtaataaacttatctgaatagaacttttagccgctttagtctgtccatcattccagtaaatgattactcttgtattcataatggaccattaagcatggagcgaaaaatggcgactcactttgcccgagggattttaacggaaggacatctgatttctgttcgtctcccctccctgtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggaaaaccggttttcagcgataaaaatttgccttcgttttctgtttcctatgccgggaatatggtcggcgtggcgttaacaaccgaaggtgaatgtggcctcgatatggaactacagcgtgcgacacgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcaactactgcccattgccggacgcctgaaatgtgctcatgtaaatcatgtagaagcgttatgcgacgcggaggacgtgctggtgtggtccgtggcggtcacgcccacgattgaaaagctcagtgtctgggagttagatggcaaacatggctggaaaagcctgcccgatattcacagccgcgccaacaatcctaccagccggatgatgcgttttgcccagctctctaccgtgaaggctttttcgccaaattgatagacaaccacaggagtcatcatgtctgaaaaattgcaggtggttacgttactggggagcctgcgcaaaggctcatttaatggcatggttgcacgtaccctgccgaaaattgctccggcgagcatggaaatcaatgcgttaccttccattgccgacattcccctgtatgacgctgacgtacagcaggaagacggttttccagcaacagttgaagctctggcggaacagatccgtcaggctgacggtgtggtaatcgtcacgccggaatataactactcggtaccgggtgggctgaaaaatgccatcgactggctttcccgcctgccggatcaaccgctggcaggtaaaccggtattgattcagaccagctcaatgggcgtgattggcggcgcgcgctgtcagtatcacctgcgccagattctggttttcctcgatacaatggtgatgaacaagccagaatttatgggcggcgtgattcagaacaaagttgatccgcaaaccggggaagtgattgatcagggtacgctggaccacctgaccgggcaattgaccgcatttggtgagtttattcagcgagttaagatctaaataaaaacccgccagcaatcatgcatggcgggtttttaacgcgctatcgattttagtgagcgtcgataaagacaatcttcaggataaacagcagcgcaacgatgattacgcacgggctaaggtcacgcagacgtccggtaccaatcttcatcacgcagtaggagataaagcccagcgcgataccttcagtaatcgagaagctgaacggcatcatcacagcggtaataaacgccggaacagattcagtaagatcctgccagttcacgcgagcaagacttgaggtcatcaacacgccaacgtaaatcagcgcaccagctgcagcgtagcctggcaccatccccgccagcggcgacaggaagataaccagcaggaacagcagaccaacaaccactgccgtcagaccggtacgaccgccaacggaaacgccggaagaagactcgatatacgccgtaacagaagaagtcccgataaacgaaccggtcacggaagagatgctgtcgacatacagtgcctgcttcatgcgcgggaatttacctttttcatccgccagtcctgctttatcggtcacgccaatcagtgtaccggaggagtcaaacaggttgaccagcatgaaagagaaaatcacccctgccagcccgaggttaaacgacccggctaaatctacatgacccacgacagtcattacgctcggcggcgcagaaacgatgccattgtagtggacatcacccagcatccagcccagcagcgtcgtcaccacgatggaaaccagcaccgccgcgtgaatgttgcgtgaggccagaatagcaatgatgaagaagccgaggatccccagcagtacgctgtgagaagtcagattaccgatgctcaccagcgtttccgggttagcgacaatcacacctgcattcttcagtcccatcatgccaataaacaggccgataccgctggtaatgcccacacgcagactcaccggaatgttggctatcatccagtagcgaacgcggaaaatcgtcagtaacagcagaccaatcgcgccccagaagattgcgcccatcccgacctgccacggcaagcccatcgcctgcacaaccacaaaagcgaagaacgcattcaggcccattgccggtgccagtgcaactggcaggttagcaaacagccccatcataatactgccgaatgcagcaatcagacaggtcgtgacgaagacggcgctggtatccatgccagcaacgccaagaatttgcgggttaacaaaaacgatgtaaaccatcgtcaggaaggtggtaaaaccggcgatcacttcggtccgtgccgtcgtgccatgttcgcgcagtttaaacacgcgttccagcatcccctggccagaagcctgggttgtgtgttgttgactcattatctatttccgaacaaggagggaaaatccgtcgctatcgtataccaaaatgagacaatatggacggctgaatataactttttttcattgtatttgcttatacggcaacgattgcgtcatgcgaattggcatgacgaaaacgttaaactaacgataaaggaaagacatgtcccagatagaagcggtatttttcgactgcgacggtacgctggtcgatagcgaggtcatttgctctcgcgcctatgtcacgatgttcagggaatttggcattcacgttgacctggaagagatttttacccgttttaaaggcgtaaaactctacgaaatcatcgacatcatcagtaaagaacagggcgtgacgatggtccaggccgatgccgagcacgtttaccgcgcagaagtagcacgtctgtttgataccgaacttgaggacatcgcaggagcgaacgaattgctggcaagcattaacgtgccgatgtgcgtcgtctctaacggtccggtcagcaaaatgcagcattcgcttggtaagctcaacatgctgcactacttcccggaaaaactgttcagcggctatgatatccagcgttggaagcccgatccggcattaatgttccatgcggcaaaagcgatgaatgtgaacgttgaaaactgcattctggtcgatgactccagcgcaggtgcgcaatcagggatagatgccggaatggaagtgttttacttctgcgctgacccgcacaataaaccgatcgttcacccgaaagtcaccacctttacccatctttcgcaattaccggaactgtggaaggcgcgtggttgggatattacggcatagttattcacactcccttcacttactccacttaaattggcacgcaaaggtaagtaaagggagtttgatatgtctgtttcacgtcgggtaattcatcacggactgtattttgcggttttagggccgttaattggtgttctgtttcttgtcctctacatattcttcgcaaaagaaccgctgattcttttggtaataatacaggtacttccattgtttctcttaatgtcgataactacgggagctattcctgcaatgttaactggcgtaatggtcgcctgtctgccggaaaagatcgggtcacagaaacgttatcgttgtctggttggcggcataggtggagtcgttatcaccgagatctattgcgctgttatcgtacatattaaggacatggcttcctcagcgttgtttgaaaacattctttctggtgaaaatctcgttgtccgcatcatcccagcattgctggcaggcgtagtgatgagcagaatcattacacatctacccggattggatatttcatgtcctgaaacagactctttaagctaagcggaatgctttatctatttgtcattaaatgttggagaacaggccggagcgtaattcacacatccggccttatttttaagcttaaccgagcgctaattctgcggcagcggctttatcagcgattaccatcagcgaaggatgcagctgcaacacggaagctggaacatcttcggtaaccggaccttgcagaacatttttcagtgcctgcgctttacctgcgccactgacaattatcagcaagtttttcgccgccatgatgcttttcggccccatcgtcacgtagctgtcaggcactaatgaaaagtcgccgcccaactcgccatgcgccacaatatcaaccatctctccctggatcgggaactccacggtttgctcatggaaatgggtcgtatttggcagattgccacaaaaatgaccatctacacctaatcccaacaccaccaaatccaggccgccttcacgcgccagtttctgatcatgctcgcggtagttatcaatagtgagcttctggatattctcttctttgatccccgcaggggtgaaaaacagattacgcagattggtaatcgttacgccttctccctctttgccgcgaaatggaatttcatcgaaattatagaaatagcagttatcgtaccagggcttacctttaaccagagtgatgagatattcgtacatgcctttgggcgtgctcccggcggtaattgccaggttaacacgacgcgtcttcgacatataaccaagcagatggtgtgccgcgacacggctcatttcctggtaatcttcggtaatgattaatttcatcttaatgccttatattatttgaataatttctgtacgaaggctgcataggcaggccgccagacatccatttcatggttcagaccgggatattcctggtaatcaaacttaatttttttctgctcaagctcagttttcagcccgacgatatccttgccggttacaacatctttatccccaacaaccacagtaaaattacgtagttgctggttaatagctgccggctcgttcagccgggcagcgacaccttcatccggtacggttgtcgtggtaacaccactgaatgtggccagccagccaaagctttccagatgattcattccggaaaccagcgcctggtacccgccttgtgaaagccccgccagcgcgcggccatcggcatctttacggacattaaaacgcttgctaatcagcgggataatatcgttcatcagttcgcgatctgccgctttagcattcagtggataaaagactttacgtctttcctgaggcacgaaatcttcgggaataatgcccttcgcatcggtttcggtatcagggatcaccaccagcatcggtttaattttcccttcagccagcaggttatccatgatttgcgggatacgcccctgatcgatagcggaacgtccggtatcaccaaaaccgtgatagaaatagagcactggcaaaggctcgcccatgccggagtatcctggcggggtccagacatacatctgacgttcggattgcaatgcgctggagtggtaagttatggtgatcaaatcaccatgcgcaacagaacgcgtatccagataactgcctggcaccagaatcatactggagttaacctgcgctgaggtttagtcattgctgtacctgtatcaatgctgcgtacaccatcaacattgaaaaaatattcgtacaggttgcctttcaggacaggtgtgcgccacgaccagactcccgcttcgtctttggtcatcgggtgaatattatccggaaccggaacacccaccactacggagacattttttgccccaggggcaaagtagcgaaaggtcacgctgttatcggcattgacctgagtcacatactgtttaaccggaatagtgggtgccgggctggctggcatatccgctgctatggcccactgagcagaaataccgctggcaatagccagcgttaaagcagcaatttttatattcatcgtaatattcctttcattaagttccattaccaccagatttcagcctgggcaccgacagcaaactggtcgtctttattgtcttcaaaggtgaagccatccagttcgttttccagggctttgatatacgtggcgtagaaacgaatttccgggcgcgaggtcaacatactggtattgactttaaaggtatggaagagcgtggttttataaccagactcattaaatttattactattcgcatctttgttttgctgggtgaaatagcccaactcaacacctgtctggttatattggtcccaaatataggccgggcgaacaaccgcacgaatagattcgaaatcagagtgtgcgcctgtttcgtagctataaatatcgttaccgaaggagtaaacaatcgcgttagccacaataaaatgatcgccgatataggcttcgccctgcgaagtcagacgaactgctgttccgccggtgtgataaccataataacgaccattaaaggtggtaaatggacttgcgccagcataacggccaaagttactggcgatagagttattcgcgaccaggaaggagaattcgttgaagccacctttatcaaatttctgcgttaaagatgtgccaaacatccaggtatctttccagtcataatacccgttattatcctgattatctttttccgatgcgctttcgtttgccgtgacataacgaccactcaccattaaggtgactttatcccataacgggatatctttatagcgtaaatcaatggtattggtattaatctgctgtttgttttgcaggctgcgatcgtaatcatcgacatcttcgcgaaccagcgcgatatcaattttacccggaccgactttccagttttccagacctacacctgcggcagcatcggtacgctgcgttttccagtcaagcatctggatttcaattttcggcgcaccgtgtttacccacccagaaatcagcctctggcgcaaagggcaggaaacctttggtggtaacgtacatatcagagaactgcataaagttctcaccaccggcgttatcgccaaaccagccagtagagtactgctgacccacgttaccatccatcatcacgatggcatcaacccgtttgccgttttcgttgtagacacgttgttttaactgcaaatcaaaccagccggagtattcgttaccaaagcggcccagagaaccaattgcccatgatttaggtgaaccatgagaggctgttccccaaccagaacggtagtagccgttgtaactaaagccgatttcatctttcacaaatttactgaaatctttcagagtcatggaagaataaatcgagcctgtctcactggcatttttctcttcatttttaaccagtacagcatcaggctttgcggcacgactggtcgggaatggattggcggcatacccttgatcattcgtacttacgctacgattcaccgtcgctggcgtatactttttcttctcttcatctttatattttttcagttcgctttgcgtttctcttaacgccttttctaatagctcaaggcgttgttccactgttaatgattcagccaatgattgtgcggaaaaggctaacggtgccattaataagatggcagaggtaataatatttcgtctaaacataatatccctttatggtgcaaagaaagaattaatgcatcgcatccagactgttctgaatgcgacgataattaaggtgctttattggttatttttttaatgatagcccccgagttttgatcacttctgcataccatccgaagcttttcttgcgcgttcttgtgaggcttccttcaccattatcatcacgatccacataaataaagccgtagcgcttagacatttgtgaatgagatgcactgactaaatcaattggcccccaactggtgtaccccataatatccacaccatcggcaatcgcttcatttacctgtaccaggtgatcgtttaaataggcaattcgataatcgtcctgtatcgaaccatccacttcaacgctgtcttttgcgcctaatccgttctcgacaataaataacggtttttgataacgatcccaaagcgtatttaacagaatccgtaatccaaccggatcaatttgccacccccactctgaacttttcagatgcggatttgggatcatattcagtatgttgccctgcgcatttttattaatgctttcgtcgtgggaaacacaaccggtcatgtaataactaaaagagatgaaatctacggtatgttttaaatcttctgcgtcactttcagtcatctcaatggtgatattgtggtcgcggaagaaacgctgcatatagccgggatactgaccacgcgcctgaacatcaccaaagaacatccagcgccggttctcttccatggcctgcaacatatcctgtggctggcaggtgagggggtaaaccagcccaccgagaagcatattgccaattttcgcttcggggatcaggctatgacaggctttaactgcccgcgcactggcaaccagttgatgatggatcgcctgataaacttccgcctcgccactctcttctgccagccccacgcccgtgaatggcgcgtgtaatgacatgttgatttcattaaatgtcagccataacgcaactttatgttggtagcgggtaaagaccgtgcgtgcgtaatgctcgaagtgatcgatgaccgcccgattagcccaaccgccgtagtttttcaccagcccatatggcatttcgtaatgggataacgttaccagcggcttgatccccgcctgcgccatttcatcaaacagccgctcgtaaaacgctaaccccgcttcattcggttcggcttcatcgccctgaggaaaaattcgcgcccaggcaatggaaatacgcagacaggtgaagcccatctcggcaaataacgcgatatcttccgggtaacggtgataaaaatcgatggcgacatctttgatattctctttccccaggatgcgcggttccatttttcccattacgccatgaggctgtaaatctgaggtcgtgatccctttgccatcttcctgccaggcgccttccacctgattggcagctgttgcaccaccccaaagaaatgtttctggaaatgctttcataattaactccttttatcgttagcgaatgatggataacagcggctcaccagcgtttatctgcgccgtgccgtggggtaatacgtccgtaaaatcatcgctattactgattaataccggcgtcgtcagatcaaatccggcctcgcgaatagcagggatatcaaaagaaatcagccgatcgcctgtattgaccttgtcacccacgttgacgtgagcggaaaagaatttgccgtccagttttacggtgtcgataccgacatgaatcaggatctccacgccatcatctgactcaatgccaatggcgtgtaatgtggcgaacaacgaagcaatttgccccgccaccggagaacgcacttcaccaacagagggcagaatggcaatacctttacccaacaggccgctggcaaacgtggtatcagcgacgtgaatgagcggcacaatctctcccgtcatcggtgaacagataccgccctgctcaggtgtaataacctctggtgttttctcttgctgggcaacttgcgctggctgacgtttagcggtgatgaaatgaaacatcaccgtaccgacaaatgcgcaaccgatggcaatgacaccgccaataacgctggcccatacggtgaaatcaatccccgttgacgggatggtttgcatgaaggtgaaaatacctggcaaaccaaaggagtaaactttcgtttgcgcgtagccaatgatggtggcccccaatgccccacttatgcaggcgataacgaaggggtacttacgcggcagattgacgccatataccgctggttcggtgataccaaacaaacctgtcaacgccgctgatcccgccaccacttttttctgcgcatcgcgttcgcagaggaagacgccgagcgccgccccgacttgcgccataatggcgggcattaacagcgggatcatggtgtcgtagcccagcacggtgaagttattgataattaaaggtatcaaaccccaatgcagaccgaacatcacaaagatttgccagaaaccgcccattaccgcgcctgcaaatgcaggaaccgcctgataaagccagagataaccggcagcaatcagttcacttatccaggttgatagcggccccaccagcagaaatgtgatgggcgtgatgaccatcagacatagcaagggtgtgaagaaatttttgattgccgaaggtaaccatgtattaagtcggcgttccagaatgctgcacaaccaggcagaaaaaataatgggaataaccgatgacgagtaattcaacaatgtgaccggaatacccaggaaatccaggcccagcgcatccactttttgcccgttctcgaaggcagtcagaattaatggatgcactaacgctccgccaatcaccatggcagtaaatggattgccgctgaagcgtttccctgcggtgtagcccaggattatcgggaagaaccaaaacaaggcatcactggcgctaaataaaattaaataagtaccactttgttcggtcgcccactgaaaagtgagtgccagagccaacatacctttcaggatcccggttgccgccatcaaaccgatcagaggcgtaaaaatacctgaaataacataaaaaaagcggtttaacagattatctttatcatcattttccggtgcctgttgcgctttttcgccaaggcctgccacgctgttaaccgccaggaagacatcggccacatggttacctatgacaacctgaaactggccaccgctttccaccaccataataataccgggggtctttttcagtacctcagcttgcgctttgctttcatcctttaacttaaaacgtaatcgcgttgcacaatgcatcagactcacaatgttatctgcgcccccgactcctgcgactattgttctggctaactccgtcataacttgccctctaccgctttgcggcaaaactccaaaaaaaaacctgaaaaaaacggcctgacgtgaatcaagcaatttttttcaggttttgcccgcttagtgcggtaacaatcctttattcagtaataatatttcagtgttctttgcgcacgcgctctatatttatggctaaaaacataatctctgcaggtgagattttacgttgatactgcaaaccaataaaaatggcgatccgctccgcacattgccatgcttgcgggtaattttgctttactgcttgttgtaatgattcatcactatcgttaatcgatgcatgttcaagaatacgccaggataaaaatttcagatgcgtaaccagtcgctgataactcaagctttcttcctggtaattaaggctgaactgaaattttattaattgcagcatttctcgcattaattgcgtgacacctgcaacatcctccatatttccgctcatttgggcactgaccagatgcatggcaataaagcccacttcatctttcggtaactgcacgcccaaccgtttatcaataatggttaacgcttcttcccctagctggaactctttcgggtaaagtcgctggatatcccacagcagcgggttgggcagtagcacgttttgctgaaagcgtttaatcgcaaactggcaatggtcagttagcgagatataaatactgtcctgcaactttcccagacgctcctgcgccagagagataatacgatcacaggttgccatcacctcaagaggcatatgacttaagagttcgcttaatcgcccgttcagttcatgactgctcaaggcatactctttttctattccacttgagttaattctttcgcctgggcgtttttgaaagccaattccgcgccccatgacgactttttcccgctgttgatcatcaataaccaccacaacattattgttgagaattttggtgatttgcatgttcatagcaaggaccttttttataaacaaaaaaacccgacttcaccagtattctctggttatgtcaggttttgcctgcgaatgcagtaacaatccagtcattaattaatggtttttataacgaacatccaggttcgaaaattaatttagttgcgtgcagaaaaaatagcaatgctctatttataaaagtatgaccatgctcgcagttattaattttgtgtaattttaggattttataaagttatatataacaaatcccaataattaaattattgggatttacttggtgaattatttatcgctatctttttctgccagcagtttatcgagctcgtcaccaccgacgtgacggaaatcctgccccttcacgtagtagaagataaactcacaaatattctggcagcggtcgccaatacgttcgatagaacgcgcacagaataacgcggtaagtacgctcggaatggtacgcgaatcttccatcatgtaggtcatcagttgacgaacaataccttcgtactcctgatcgacttttttatcttcacgataaatacgtaccgcttcgtcaatgtccatccgcgcgaacgcgtccagcacgtcgtgcagcatctggatggtatgacggcccagcgactccagacttaccagcaatggctgatgctgctgggagaatttctccagtgcagtacggcagattttgtccgccacgtcgccaatacgctccagctcggcaatggttttactgatcaccataaccagacgcaggtcgctcgccgtcggctgacgtttggcgataatgcgcacgcaggcttcatcgatcgccacttccatcatgttgacgttcttgtcgccttcgatgacgcgcttcgccagatcgctgtcctggttatgcatcgcggtgattgcatcagaaagctgctgctccaccatgccgcccatggtcatcacctgcgtgcggatgctttccagttcggcgttgaactggccggaaatatgtttattaagattgagactgtccataacgcactcctgaatcaaccgtaacgaccggtgatgtagtcttctgtttgtttcttcgctggcttggtgaacagatcgtccgtgttgctgaactcaatcaattcgcccaggtacataaacgccgtgtggtcggaacaacgcgcagcctgctgcatgttgtgggtgacgatcaccacggtgtaatcctgcttcagttcggtgatcagctcttcaatacgcccggtggagatggggtcgagcgccgaacacggttcgtcgagcagcagtacttccgggcgaatggcgataccacgcgcaatgcacagacgctgttgctgaccaccagagagagagtaaccgctctggtgcaatttatctttggtttcgttccacaatgcggctttggtcaatgcccactgcacgcgctcgtccatgtcagcacgggagagcttctcaaacagacgcacgccaaaagcgatgttgtcgtagatggacatcgggaacggcgtcggtttctggaacaccatacccactttcgcacgcagcagggcgatatcctgagagttggtcaggatgttgtcgccatcgagcagaatttcaccttccgcacgctgttccgggtacagttcaaacattttgttgaaggtacgcagcagcgttgatttaccgcagccggacggcccgataaacgccgtaacctggtttttggcgatatccaggttgatgtttttcagggcatggaatttgccgtagtagaagttcaaattacgaacctgaattttactcggggcagtttcaaccatactcattgcaatcttttcctcatcgtgcctgatgcacttcgcgaatcaggcttaccgtaggccggataaggcgtttacgccgcatccagcaaagtgttaaccgtgtttattcttcgcaaaaacaacgcgcgccagaatgttcagcagcagtacgcacagggtaatgatcaacaccccggcccaggccagttgctgccattccgcaaacgggctcatcgcaaacttaaagatcgtcaccggcaggttggcgatcggctgcatcatgtccgtgctccagaactggttggagagcgcagtaaacagcagcggcgcggtttcaccagcaatacgggcaatcgccagcaggataccggtcatgatcccggacaccgacgctttcagcgtgatcgcggcgatcatcttccacttcggcgtacccagcgcataagccgcttcacgcaggctgtccggcaccagtttcagcatgttctcggtggtgcggataacaatcggcacctgcaacagcgccagcgcaatcacgcccgcccagccggagaagtgctccatctgcgccaccacaatggtgtaaacaaacagaccaaccacaatcgacggcgcagagagcagaatgtcgttaatgaagcgaatcacttctgccagccaagatttacgaccatattcagccaggtaaatccccgccataatgcccagcggcgtaccgaatacggtagcccacaaaattaacaggccgctacccgccagggcgttcgccagaccaccgccttccgtattgggtggtggcgtcatttcggtgaacagcgccagcgacataccgtcgataccgcgagtgatggtggacattaaaatccagatcagccagaacagaccgaaggccatcgtcgccattgagagcgtcagcgcaatacggtttttgaggcggcgacgcgcctgcattttgcggcgggattcagccagtgccgcagtggtttgcatttcaaccatagccattagcgtgccccctcattcttagccaggcgcataatcataaacttcgatgcggcgaggacgatgaaggtaatcacaaacaggatcaggcccagttccatcagtgcagcgacgtgcagaccggattccgcttccgcaaattcgttggccagcgcagaggtgatactgttgcccggcatatacagcgaggcgctgtcgagttggtaggtgttaccgatgataaaggtcaccgccatggtttcaccgagcgcgcgccccagccccaacataatgccgccgataacaccatttttggtgaacggaagaacgatacgccagataacttcccaggtggtgcagccaataccgtaggccgactctttcatcatcaccggggtttgttcgaatacatcgcgcattaccgctgcaatgtacggaataatcatgatggcgaggatcacgcctgccgcgaggataccgataccaaaggccgggccggagaacagcgcgccgacaatcgggatattcgacatgatattgccgaccggctcctggaagtaaacggcgaacagcggcgcaaagataaacaggccccacatgccgtaaacgatacttggaatggcagccagcagctcaatggcgatacccagcgggcgtttcagccagccaggcgcaagctcggtcaggaacagggcgataccaaaactcaccgggacggcgatcagcagcgcgataaacgaggtcaccagcgtaccgtagatcggcaccagcgccccgtagatatcgttcggcgcatcccactctttggtccacaggaaagccagaccaaatttctgaatgctcggccaggatgagatgatcagagagacaataatgccacccaacatcaatagcacaatcagcgccgccagttttaccagcacgctgaaaattatgtcgccctttttacccggtgggttaaaagcaggcttggttgcagccataagttactcttcagttaaacgcgtttacaaagtcattttgtaatgccggatgcggcgtaaaacaccgtacccggcctggagttttattagtacagcggcttgccgctactgtctttaatattggtcttccacgcagcgcgaacctgttcaactacgctatccggcaggctggcgtaatccaggtcgttcgcctgtttagccccggttttgtatgcccagtcgaagaacttcaacacttcggtgccttgttctggtttcttctgatctttatggatcagaatgaacgtggtagaggtaataggccatgcatcttcgcctttctggttggtcagatcctgagcgaatgttttgctccagtctgcgccttttgctgcattagcgaagttttcttcggtcggactcaccggtttgccatcagcggagatcagtttggtgtacgccaggttgttctgcttcgcgtaagcatattcaacgtaaccaattgcacccggcagacgctgaacgaacgcggcgataccgtcgttacctttaccgcccagaccgatcggccattttacggtagagccagtaccaacgttgtttttccactcttcgttcactttcgccaggtagctggtgaagacgaaggaagtcccggagccatctgcgcggcgtactacagcaatgttctgtgaaggcagtttcagacccggattcagtttggcgatggcttcatcatcccacttcttgattttgcccaggtagatgtcgccgagggttttaccatccagcaccagttcgccagacttcagacctggaatattaaccgccagcaccacgccgccaatcacggtcgggaactggaacaggccttcctgagccagtttttcatcagacagcggcgcgtcagaggcaccgaaatcaacggtgttagcgataatctgttttacgccaccggaagaaccgataccctggtagttaactttattaccggtttctttctggtaagtgtcagcccatttggcatacaccggcgcagggaaggttgcacctgcacctgtcaggcttgcttctgcaaacacagagaaagcgctcatcgataaggtcgcggcgacaacagttgcgacggtggtacgcataactttcataatgtctcctgggaggattcataaagcattgtttgttggctacgagaagcaaaataggacaaacaggtgacagttatatgtaaggtttatgacagttttatgacagagagagaatgtcttcagtccgatttaaataagagtttatattcagttaattacaaatattaataacgaagagatgacagaaaaattttcattctgtgacagagaaaaagtagccgaagatgacggtttgtcacatggagttggcaggatgtttgattaaaaacataacaggaagaaaaatgccccgcttacgcagggcatccatttattactcaaccgttaccgattttgccaggttacgcggctggtcaacgtcggtgcctttgatcagcgcaacgtggtaagccagtagttgcagcggaacggtgtagaagatcggtgcaatcacctcttccacatgcggcatctcaataatgtgcatattgtcactgctcacaaaacccgcatcctgatcggcgaagacatacaactgaccgccacgcgcgcgaacttcttcaatgttggatttcagtttttccagcaattcgttgttcggtgcaacgacgataaccggcatatcggcatcaatcagcgccagcggaccgtgtttcagttcgcctgcagcgtaggcttcagcgtgaatgtaagagatctctttcagcttcaatgcaccttccagcgcgattgggtactgatcgccacggcccaggaacagcgcgtgatgtttgtcagagaaatcttctgccagcgcttcaatgcgtttgtcctgagacagcatctgctcaatacggctcggcagcgcctgcagaccatgcacgatgtcatgttcaatggaggcatccagacctttcaggcgagacagtttcgccaccagcatcaacagcacagttaactgggtggtgaatgctttggtggaggccacgccaatttccgtaccggcgttggtcatcagcgccagatcggattcgcgcaccagagaagaacccggaacgttacagattgccagcgaaccaaggtaacccagctctttcgacagacgcaggcccgccagggtatccgcggtttcgccagactgtgacaaggtgatcatcaggctgttacgacgcacggcagatttgcgatagcggaattcagaggcgatttcgacgtcgcacggaatacctgccagcgattcaaaccagtagcgggaaaccataccggagttataagaagtaccacaggcgaggatctgaatatgctcaaccttcgacagcagttcatcggcgttcggtcccagctcgcttaaatcaacctgaccgtggctgatgcgcccggtaagggtgtttttgatcgcgttcggctgttcgtagatctctttctgcatgtagtggcggtaaatacctttatcgcccgcgtcatattgcagattggattcgatatcctgacgttttacttccgcgccagttttatcgaagatgtttaccgaacggcgagtgatttccgcaatatcgccctcttcaaggaagataaagcgacgagtcactggcaacagcgccagctggtcagaagcgataaagttttcgcccatacccaggccaatcaccagcggactaccagaacgtgccgccagcagggtatccggatgacgggagtccatgatcactgtaccgtacgcaccacgcagttgcgggatagcacgcagaactgcctcacgcagagtaccgccttgtttcagctcccagttcaccaaatgtgcaatcacttcggtgtcggtttcagaaacgaaggtatagccacgcgcttttaactcttcacgcagcggttcatggttttcgatgatgccgttatgcaccaccacaatgtgttcagaaacatgcggatgcgcgttagcttctgaaggttcaccgtgggtcgcccagcgagtgtgagcaataccggtgccgccatgcagaggatgttcttccgctgcctgagccagcatctgtactttaccgaggcgacgcaggcgggtcatatgaccttctgcatcaacaacggccagaccggcagaatcatatccgcggtattccagacgacgtaaaccttcaagaaggatttctgctacatcacgttgcgcgatcgcgccaacaattccacacatagtttttgattccgatttatatcgttgtcggtcaacctgtatgcccgtttttcgggcgccccgagccttgtagagagtggggttatttttatagttactgcttgtgggcgggagattatgttatctcctcatcccatatgaccggattacccggccagaattactttttctttaccggacgacgccagccttctttttgagtctgcggcacacggctgatcgccagggcattttcgccgacattacgcgtcacagttgtacccgcagcaatggtcgcgcctttgcctactgttaccggggccaccagttgagtgtcggaaccgacaaacacatcgtcgccgataatggtcttaaatttattcgcaccatcgtagttgcaggtaatggttcccgcgccgatgttaacgttatcgccaatttccgcatcgcccaggtaagtcagatgaccagctttcgagcctttacccagacgcgcttttttcatctcaacgaagttaccgacgtgtgcaccttccagcaactcagcaccaggacgcagacgggcaaacgggccaatagtacaggccgcagccagattcgcgtcttccacgacggtatatggactgatttcgcaatcatcgccaatcacgctgtttttaatcacgcaaccggtgccgattttcacgcgatgaccgagagtcacgttgccctcgatgataacgttagtatcaatttcaacatcgcgcccgtgagtaagcgtaccgcgcagatcaaaacgcgccggatcgcgcagcataacacctgctaacagcagtttttcagcctgttcggactggtaaacgcgctccagtcgggagagttgcaggcggttattcacgccttctacttcgcttaaacgttgcggatgaacggcgacgatttcacgtccttcctgatacgccagcgcaataatgtcggtgatgtagtattcgccctgagcattattgttggtcagcttcgccagccagcgtttcatatctgcgccgttggcaatcagaatgccggtgttgatctcctgaatctgacgctgctcgtcggtggcatctttgtgctcaacaatgccggtaactttgccgttttcacgggtgatacgtccataaccggtcggatcatccagttttaccgtcagcagaccaatgccaccctgcggtttagcatcacgcagacgctggagtgtttcgacagagatcagcggcacgtcgccgtagagcattaaaatgtcttcatcatcggcaaagaaaggtgcggcctgctgcatcgcatgacccgtacccagctgttctgtctgaagcacccagttcaggttgtcgtctttcagcgcctgcttaagcagatcgccgccgtgaccatacacaaggtgaacgtgcgctgcgcctaattcattcgcagcatcaatgacatgctgaaccatcgctttcccggcaagggtatgcagcactttcggaagatcggaatacatgcgcgtgcctttgcctgcggcaaggatcactacgctcatagcattattcaacatacgcgtcctgactgtaatttgagaacgaatttaaaccgcttcaccttgaaaaaactacatttttttcatcgtgaaatggacagaggataaattgttcaataacggattatccccgctgacgaaagcgccattttcgaccatcgtcacgccttttgtctgcagaaaattaaggcagtaccttcatttaagcgtcaggtggatgtttttgctcttatttcgatcaatgaataaacgggaaaacaggggtgttttatatcatcaggatctatgtgaacgcttttcaggacgggtcaatacgcgtaaaaaaaagccagcctgttgccagactggcttttgtgcttttcaagccggtgttacatcgcttttttggtcaactcgataacgcgcagctgcgcgatcgctttggccagttccgcagacgcctgagcgtaatctacgtcgccgtgagagctgctaatgtgctcttcagccttacgtttcgcttccatggctcgcgcttcgtcgagatcctggccgcgaattgcggtgtcggccagaacggtcacgttgccaggctgcacttcaagaatgccgccagacagatagataaactcttcgtgaccgtgctgtttcacgatgcgaatcataccaggcttaatggcggtgagcagcggtgcgtggccagggtagatccccagttcaccttcgctacccgttacctggattttctcgaccagaccagagaacatttgttgctctgcgctgacgacgtccaggtggtaagtcattgccatatcaccctccgattaaggcgttaaagttttttggctttttccacagcttcttcgatggaaccgaccatgtagaacgcctgctccggcaggtgatcgtattcgccttccatgatgcctttaaagccacggatggtgtctttcagggagacgtatttacccggagaaccggtgaatacttctgccacgaagaacggctgggacaggaagcgctggatcttacgagcacgcgctaccaccagtttgtcttcttcagacagttcatccatacccaggatggcgataatgtctttcagttcctgataacgttgcaggatggactgaacgccacgcgcagtgtcgtagtgttcctgaccaaccaccagcgggtccagctgacggctggtggagtccagcgggtcaacggccgggtagatacccagagacgcgatctgacggctcagtaccacggttgcgtcaaggtgcgcaaaggtggttgccggagacgggtcagtcaagtcatccgcaggtacgtatactgcctgtacggaggtgatagaaccggttttggtggaggtgatacgttcctgcagaacgcccatctcttccgccagggtcggctgataacctaccgctgaaggcatacggcccagcagtgcggatacttccgtaccggccagggtgtaacgatagatgttgtcaacgaacagcagaacgtcacgaccttcgtcacggaatttctcagccatggtcagaccggtcagagcaacgcgcagacggtttcccggcggctcgttcatctggccatacaccagggatactttgtcgataacgttggagtcggtcatttcgtggtagaagtcgttaccctcacgagtacgttcacctacgcccgcaaacacagagtaaccggagtgctcgatcgcgatgttacgaataagctccatcatgtttacggttttacctacacccgcaccaccgaacagaccaactttaccgcccttagcgaacggacacatcaggtcgataactttgataccggtttccagcagttcctgagagtttgacagctcttcgtaggaaggtgctgcgcggtgaatcgcccaacgctcttcttcaccgatctcgcctttcatgtcgaccggttcacccagtacgttcatgatacggcccagagtcgctttacctaccgggacttcgatcgggtgttcgaggtcttttacatccagaccgcgacgcagaccgtcggaggaacccattgcgatggtacgcacgataccgccgccgagctgctgctgaacttccagcaccagacgctcattaccattttgcacctcaagagcatcgtacacgcgcggtacggcatcctgagggaattcgacgtcaactacggcgccgattacctggacaatctttccagtagccatcttaaatcctctacgaaataacctgtttaaaccgcggcggcccccgagacgatctcggtgagttcctgagtaatgctggcctgacgagctttgttgtataccaactgcagctctttaatcaggctgccgccattgtcggtcgcggctttcatcgccaccatacgggcggcctgctcgctggccaggttttcaaccacgccctgataaacctgagattcgacataacgacgcagcagggtatccagcaacgccttcggatcgggttcgtacaggtaatcccaggatttatgtttcagatcatcatcatctgatgccggtaacggcagcagctggctgatggtcggaacctgagacatggtgttaataaatttgttgctgacaatgtaaagcttgtccagacggccttcgtcgtaggcctgcaacatcacttttaccggaccgatcagttcggacagggaagggttatcccccatgccggtgacctgggcaacaacattgccgcccacggagttgaagaacgacacgcctttcgagccgatcattgcgaggtcgcattgaacgcctttgtcggtccaggtcttcatttccgccagcagttttttgaacaggttaatgttcaaaccaccgcacaaaccacggtcggtcgacaccaccaggtagcccacgcgtttaacgtcgcggtcttccaggtaagggtgcttatattccagattaccgtgtgcaaggtgaccaatcactttgcgcatggtttctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaaggcaagccgccagacgttaccaggattgggttgctttgaaggaatcgaggatgcctttcagcttgccttcgatttcgtcgttgtagccaccggtctggttgatctcttgcatcaacggagcgtgatcacggtcgacgtaagccagcagagcggcttcgaagctgccgattttcgacagttcaacatccgccaggtaaccacgttctgctgcgaacagaaccagagactgttgcgcaacagacatcggcgcatactgtttctgcttcagcagttcggtcactttctgaccgtggtcaagctgcttacgtgttgcatcgtcaaggtcggatgcaaactgagagaacgctgccagttcacgatactgtgccagagcggtacggataccaccggacagttttttcatgatcttggtctgtgctgcaccaccaacacgggatacggaaatacccgggttaaccgcaggacgaataccggcgttgaacaggttggtttccaggaagatctgaccatcggtaatggagattacgttggtcggaacgaacgcagaaacgtcacccgcctgagtttcgataatcggcagcgcagtcagagaaccggttttccctttcacttcacctttggtgaaagcttcaacgtattcggcgttaacacgcgcagcacgctccagcagacgagagtggaggtagaatacgtcgcctgggaatgcttcacgtcctggcggacgacggagcagcagggagatctgacggtaagcaacagcctgtttagacaggtcatcgtaaatgatcagcgcatcttcaccgcggtcacggaagtattcacccattgcgcaaccagcgtacggtgccaggtattgcagtgctgcggattcagacgcggttgctaccacaacgatggtgttagccagtgcgccgtgctcttccagtttacgtaccacgttagaaatggtggacgctttctggccgatagcgacatagatacatttgataccggaatcgcgctggttgatgatggcatcgatagccagtgcggttttaccggtctgacggtcaccgatgatcaattcacgctgaccacgaccgattgggatcatggagtcaacggctttataaccggtctgtaccggctgatctacggactgacgttcgataacgcccggagcgattgcttctacagcagagaagccgtcgtgatccagcggacctttaccgtcgattggtgcacccagagtgttaaccacacggcccagcaggccacggccaaccggaacttccaggatacggccagtacacttaactttcatgccttcggcaaggtcagcgtacggccccataacaaccgcacctacagagtcgcgctcgaggttcagtgcgatagcgtaacggttacccggcagggagatcatttcaccctgcatacaatcggccaggccgtgaatgcggataacaccgtcacttacagaaacaatagtaccttcgttgtgagcttcactcacaacattgaactgagcaatgcgctgcttgatcagttcgctgatttcggtggaattcagttgcatgctccagtccccttaagactgcaagacgtctgcaaggcgctcaagacgaccgcgtacgctgccatcaatgaccatatcacccgctcggatgataacgcctgccattacagacttatcgattttgcaattcagcttaactttgcgtgacagacgtttttccatcgcagcagaaattttcgcgagctgttgttcactcagtgcggcagcggaaatgacgtctacctcagcggtagcctcactcacggcacgcaggtgaataaactgctccagaacatccgggagcgcgttaagacgaccattttcagccattacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcgtccagaatctgcgagcggcgtttgttagcctgctcgatgattacctgggcttccgctttcgcttttttcagctggtcggtcgcgctggcctttgcaaggtcaaggtccttatgtgctcgttctgcggaagcaaggccgtcagcaatttctttttgacgtttttcgatggctgccattaatggcggccatacgtacttcatgcagaacagaacgaacaggacaaacgcgatggcctggccgaggattgttgcgttaagattcacagcacaatgcctctatttagttaacgttctgatattgctctttaaataaaagcaacgcttactacgcgacagcgaacatcacgtacagacccagacctacagcgatcatcgggatagcatccaccagacccataacgataaagaactgagtacgcagcagaggaatcagatcaggttgacgcgctgcgccttccaggaatttacccccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgttcttcagacgccatcgacagatagacgatcgtcagaaccatgaagatgaaggcttgcagcgtaatgatcaggatgtggaaaatggcccacggcacattcaggatccactgtgaccaccacggcaacagaccagcaatcagaatgaaaatcagctcaccggcatacatgttaccgaacagtcgcaaaccgagtgaaactggtttggacagcaggcttaccccttcaaggattaagttgacaggaatgaacgcccagtgattgaacggctgcagcgtcaactctttcgtgaagccgccgatgcctttcattttgatgctgtagaacagaatcaggataaatacgcccagtgccatagacagcgttacgttcacgtcagcagacggaaccacacgcagtgcaggcagacccagtacatgttcagcaatgtacggcagcaggtcgataggcagtaaatccatcaggttcatcaggaatacccagacgaagatcgtcagggccagcggagcaatcagcttgcttttgccatggtacatgtctttcacgctaccattaacaaagccgatcaccagctcaatcgcggtctgaaacttacctggcacgccgctggttgcctttttggctacactacggaataaaaccaggaacaacagacccagcaccaccgagaagaacatggagtcaatattgattgtccagaaggtggctggggggttatgtggatccaccagcgagaatgtacgcaggtccagctgaaggttattcaggtggtgtcctatgtaatcctgcggcgtcatattttctgaagccatgatgccttttaccctttgttgttaattacagccggtgccagtatctgaaccaccagcaccaaaacccacgtaacgatcagcggcaagaataccgcctttaaaaccgccaacgccaccaccagtaacaccaacatcgccagaactttgaaagcttcgccaaatgcgaatgtccaggccacccggcctttcgctggtgtatgcgcctggtgacgccaggcaaatatcataaacaaaacgttaggcagaaagactgccaggcccccgcttattgcagagacgccccagaaggggtctttgaggctgaacagcaatccacttgctatcaccaccagtaactgaacgagcagaagcttccgagcaacgtttcgactcacgagcgacacagacatcacgtttttcactcctgctcccttcgaggtatgccgcgtgtcgtataaaactttctttaaggcttagagtcaagcatcaaaaagcggtcaaattatacggtgcgcccccgtgatttcaaacaataagtagccaaaaggtgaataaatgtttaaatatttttccagtgcatacaattgcgacttttctgcaaaccctgttcgatcatgaaaaactgtaaataacgcgtaaacactggtgataaagcgtgcttcagatcacatattgcgcatgttcgcgcacagcatatttatttacttggcaaatgatgcctttgcaagtttatgatatttcagtctaaaaacagatactgttttaataaatgacatttacataacaaaaaccacccattgacatttttaataatgttttaacagtcaatgatgattcttagcgccgatttttagcagactgatattttcacttatgacttattttctgcttaccaaaaaaagccacgttatcttgttgatacaaaagagtgaacgtggcgttaaatgtaaccagttatatcagtagaaaacctggttgttgttaacagtctaaccggtcaattttttatgatttttttgataaaaattaaattttatttgctttaatcaccaccagatgacgttcgccatccagggctggaacctgaagtttaaccactgattcgacctgatattcctcgggcaacaaagcgatttcatcttccggcatttgccctttcagcgcgtagaaacggccttgctcaccaggaagatggtggcaccagctcaccatatcgttcagagaggcaaaagcgcggctaattacgccatcaaatggcggctctgacggaaactcttctaccctgctctgtactggctcaatattctccagtttaagctcatgttgcacctgacgaaggaaacgcacgcgtttaccaaggctatccaacaacgtgaaatgagcttcaggacgcacgatagagagtggaatgccaggcagtcccggtccggtgccgacatcgataaaccgttcaccttgcagatacggtgccaccacaatgctatcgagaatatgtcgtaccagcatctcattaggatcgcggaccgaagtcaggttgtacgctttattccatttatgcagcatattcacgtaggcaataagctggtttttctggtgatcggtaagcgaaatacctgcgtctttcagcagtaaggagagtttgttgagcacggtgattacctgttcttgatgcgttgcctggtaagcgggtgcttaccaggcatttttaatgcgttatgcgctacgacgcagcataccctgttttttcagccacaccagcagaatggagatagccgcaggcgtgacgccagaaatacgcgaagcctggccaatagaggccggtttgtgatcgttaagtttggcgatcacttcgttagaaagaccggatacctggcggtaatccagcgtcgctggtagcagggtattctcgttacgcagctgcttttcgatctcatcttgctggcgcgcgatataaccttcgtatttaacctgaatctcaacctgttccgcagcctgttcatctgtcaacgcaggggcaaacggtgtcagcgtggttaatttttcataagtcatttcaggacgacgtagcagatcttcaccactggcttcacgggaaagcggcgcagtcaggtgagcattcacttcggctgcagcttccgccgacggggttacccaggtcgatttcagacgctgacgctcacgctcgatattctcaagtttctcgttaaagcgcgcccaacgttcgtcatccaccaggcccagttcgcgaccgatttcagtcaaacgcagatcagcattatcttcgcgcagcatcagacgatattctgcgcgcgaggtaaacatacgatacggttctttggttcctaaagtgcacaggtcatcaaccagtacgccgagatatgcctgagaacgcgccggagcccaaccttctttgtcagcagacagacgggcagcgttaagaccagccagcaaaccttgcgcagcggcttcttcgtaaccggtagtgccgttaatctgaccagcaaagaacagcccctggataaacttgctctccagcgtcggtttcaggtcgcgtggatcgaagaagtcatactcaatggcataacccggacgcacgatcttcgcgttttccatcccctgcatggagcggacgatttgcatctgcacatcgaacggcaggctggtggagataccgttcggataaatttcgtttgaggtcagcccttccggttcaaggaagatctgatgctgatttctttcggcgaagcgcatgactttgtcttcgatcgacgggcagtagcgtgggccgacaccttcgatcacccctgcatacattgggctacgatcgaggttactgcggatcacatcatgggttttctcgttggtatgggtgatataacacggcacctgctgtggatgctgggacgcattacccataaacgagaataccggcattgggttatcgccatgctgttgcgccagcacgctgaagtcgatagtacgtgcatcaatacgcggcggtgtcccggttttcagacgaccaacgcgcagcggcagttcacgcaaacggcgagagagcggaatggacggcggatcaccagcacggccaccgctgtaattatccagaccgatatgaattttaccgtcgaggaacgtcccaacggtgagcacgacagctttggcacggaacttcagtcccatttgggtaacggcaccgaccacgcgatcgttttcgacaataagatcttcaaccgcctgctggaagatcatcaggttcggttggttctccagcgccgtacgtaccgcctgacggtagagcacacgatctgcctgagctcgggtagcgcgaaccgccggtcccttgcttgcgtttagtatcctaaactggatacccgcctgatcgatcgctttcgccatcagaccgccgagtgcatccacttcttttaccagatgtcccttcccaataccgccgatcgccgggttgcagctcatctgccccagagtgtcgatattgtgtgtcaaaagcagagtctgttgacccatacgcgccgcggccatcgcggcctcggtgcctgcatgacccccgccaatgatgatgacgtcaaaaggatccggataaaacatggtgattgcctcgcataaagcggtatgaaaatggattgaagcccgggccgtggattctactcaactttgtcggcttgagaaagacctgggatcctgggtattaaaaagaagatctatttatttagagatctgttctattgtgatctcttattaggatcgcactgccctgtggataacaaggatccggcttttaagatcaacaacctggaaaggatcattaactgtgaatgatcggtgatcctgggccgtataagctgggatcagaatgaggggttatacacaactcaaaaactgaacaaccgttgttctttggataactaccgtttgatccaagcttcctgacagagttatccacagtagatcgcacgatctgtatacttatttgagtaaattaatccacgatcccagccattcttctgccggatcctccggaatgtcgtgatcaagaatgttgatcttcagtgtttcgcctgtctgttttgctccggaatttttgagttctgcctcgattttatcgatagccccacaaaaggtgtcatattcacgactaccaataccgattgcgccaaagcggaccgcagaaagatcgggcttctgttcctgcaatgcttcatagaaaggagaaaggttgtccggaatatctccggcaccgtgggttgagctgataaccagccagatccccgaggcagataaatcttccaacagcggaccgtgcagcgtttcggtggttaaacccgtctcttccagcttttcagccaggtgttctgctacatattcggcaccgccgagggtgctgccgctgataagagtgatatctgccataaaccgccacctttattaagagtggcgtattgtacgctgtgaacgcgttgggatctacctgtggaaaagtatgggattaaaaaagccgatcagggcttaatggtacgcatgatcggattctgcaggacgatcagtgtctcggtggactgaatttcatcaattgtttggatcttgttgataagtacatgctggagagcatcgatcgaacggcacatcacttttataaagatgctgtagtggccggttgtgtaataggcttcagtgacttcatcgaggctttccagctttgccagcgcggaaggatagtctttggcgctctttaatataatgccgataaagcagcctacgtcataaccaagctgcttcgggctgacatcaatacgcgccccggtaatgatccccgcctgcttcattttctctactcgaacgtgaatcgtccccgggctgacgccaaattgtttcgccagttcggcgtaagcggtgcgcgcattgcccattaatgcttccaggatgcctcggtccagattgtcgatcagataattttccataggattttcttatgcggattgatgattcattctattttagccttcttttttaatgaatcaaaagtacgtgaggctttttattgaatgattattgcatgtgtgtcggtttttgttgcttaatcataagcaacaggacgcaggagtataaaaaatgaaaaccgcttacattgccaaacaacgtcaaattagcttcgtgaaatctcacttttctcgtcaactggaagaacgtctggggctgatcgaagtccaggcaccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttccccgttgcactcggtctatgtagaccagtgggactgggaacgcgtaatgggcgacggcgagcgtcaattctcgactctgaaaagcacggtagaggcgatctgggagggaattaaagcaaccgaagctgcggttagcgaagagtttggcctggcaccgttcctgccggatcagatccacttcgtacacagccaggagttactgtctcgttatccggagctcgatgccaaagggcgtgagcgggcgattgcgaaagatcttggcgcggtattcctggtcgggattggcggcaagctgagcgatggtcatcgtcacgacgtgcgcgcaccggattatgatgactggagcaccccgtcagagctgggccatgcgggtctgaacggcgatattctggtatggaacccggtactggaagatgcgtttgagctttcttccatggggatccgcgtggatgccgacacgctgaagcatcagctggcgctgaccggtgacgaagatcgcctggagctggagtggcatcaggcgctgctgcgcggtgaaatgccgcagaccatcggcggcggtatcggccagtctcgtttgaccatgctgctgctgcaactgccacatatcggccaggttcagtgtggtgtatggccggcagctgttcgtgagagcgtcccttctctgctgtaataatttatcgccgccagcgtctgagcaggcggcttcgcatcccggtatcaaagcgccagatatgatcgaaaatgcgcatgatgccgggtttgccatgtgccgacatcgccacggcatgaaagcgatgctgatgtacccgctgcaactctttcactttgctcgtcacgtcgtcaggtaaccgctgggcgataaaatcagaaatcaccaccgcatcggcatcaaaccattcccggctttgcaagcgttccataatggcgcgaaaacaactggccagatcggtgccgccacgaaactgctggcttaaaaaacggattgcttgttcgatgccttgtgggcctgaaagctcataacggacgatctcggtggaaaatagcataatatagcagcgccggttttcagcgagggctatgcgcatcaaggccaggcagaacgctttcgcacactgttcattaaagccgcccattgagccggaagtatccacgcagacaataaacggtccgcgcggctgttcgtcgtaatctttatgcaccaccgggcgttcgatcattttttcacgccacgactcaccatgcaggcgataggtgagcaactgtttttccaccagccgacggtaaaactcatactccagttccgttatccctagtgtcgccagttctggcggcaagagacgtaaaatatcatcgctttgctgcagaccatcaacctgctcaggaactgtcgccggttcgcgcaccatggtgcggaaggtttccatctgcgcatcgttgcgcggtattgatttggcttcccgggaacgccccagctgttctgccagacgtttcagttccggctgttcgttaagaaattcaccgtatttcacaatcaactgatagtcgccacgtttaagctgaccggcgctcatatcccacagacgaccagctgcggtattgttatctgcgagaatcggttcaagttgcccgctcagcgtcatgcgttcctgaacttcactcaacagttgttcgcgttcttcttctaatagctgctgatttaacgtcgttgcttgcacgatcaggcttaaacgccagcgctggagaaaaagcgtgtgtaacgctgaagtgatcgtgctgttagcatcaaccaactggcgggcttgttctgcccatggggaattcagacgatgcagtaagtccaggatttgtggtagctgcacaataaactgcggcgtggagaggagctggctttgctgatagcacatcacctcttcggtgagttccggcgggactcgggcatctttcagccgactgcgcagcgcctcacgccagcggggaacatcatcagtgattgccgccttcagtcgtgggaatttttcaaagaagactgccagctgcggtgaggccagcagcgcgatgatcatctcttcgatcaatccctcttcgctgacggccagcatcacattaagcgtatccagcgttagcattgttgtgcctggcgaatctgtgcgccgacatcctgtaggctggcttcaatgcgacctaaccagtcgccagggataaacagacatttttgctgttcgctgaataaagcgtgttgcttgcgccagtcgctttcaagctcttccagttgttgttttatttcacctggcagaccttcagccgatgaacctggaagtgctagcgtactgccttgtaaacttacatcgcgtacaacaagatgttgggcgctatcgacttccagattcagtttctgggcaaagccgataccgttcagtttgccgcgaatctcaccacctttactcagccactgttccagcgcgctacgctcaaaggagatatgaaccacttccatatcatgcagttttaacggtttttgcagcagcagagtcagagtggaagcagtaacgttaacagggagttgatactgctgacgacggctaaaaatgccgcccagacgaattaccgttaaggctgttttatcgctttgttgctgctgaagttgcaggtgacgttgcacaatcgcgcccaggcgggtcaacatcccttgctgttgccaggcgtgaccggtcatcaatacatcaatttgttgttgtatcaaattcaggctttgcgcgtcataccacaggcaatctttcagcaaaatgagatcaaccggggcgacagcactgcgaccgctaaaaaaggcgctggcctgcaataagcggatcgcttttttccagcgacgatccgagacataaggcgcatccggtaatttatccagttgctggcgcagcataaaaatcagctcaaatacatgatcgggcagcgtaatttcaccaatctctttctgccagcgttcatattcttcatctgtgatctgcaaggaggcaggaaccggattgtcattttcatcctgttgactggtcagcatggagcggaaattcgctttatcctgcactttatctaaccacagacgaatcagcatgcggtcatataacgcttccagactgctgtctgcttccggcagctcgttggaggccgccaccagcagacgcatcgggattttttctacgagtgcgccgttgcggaactggcgctcgttaatggcggtgagcagggtattaagaattgccggacccgctttccagatctcatccagaaagacgatttcagcttccggcaggtaaccgctggttaaacgttcatagcgcccttcatcttttagcgcctgaatagaaaggggaccaaaaacttcttccggcgtggagaagcgggtcatcagatattcaaacgcgcgggcattctgaaaggcgaattttaagcgccgggcgatcaaacttttggcaatacctggtgggccaaggaggaacacactttcaccacttaatgccgctaataaacacaagcggatggcgtggctacgttcataaagccccttttccaacgaactgctcaggcgggaaattctttccgctaataaatgagggtgagccataatgaagtggcgtcctttcgtcaaaagttctgcgtaaattgcgagtatagacgtttcttgctggtggctaaaatagtctcaaaggaggggtatttttctttgagccaggttaatgtggccgcatttaggagtacgattttgccgttaatcgtgcatactgtgcgcttttttgtgggccaagggactaagcacacatttcatatttcaacgaaagactagtctatgagcactgataataagcaatcattgcccgcgattaccctcgcggcgattggagttgtctacggcgatattggtaccagcccgttatatacacttcgtgaatgtttgtccggccagtttggttttggcattgaacgcgatgccgtgtttggctttttatcgctgatcttctggctgctaatctttgtggtttccattaaatatctcaccttcgtgatgcgggcagataacgccggtgaaggggggatcctgacgttgatgtcgcttgccgggcgtaatacgtcggcgcgaaccacatcaatgctggtgattatggggctaatcggcggcagctttttctatggtgaagtcgtcattactcccgctatttcggtgatgtccgccattgaaggtctggaaatcgtcgccccgcagctggatacctggatagttcccctctcaattatcgttctcacattattattcatgattcaaaaacatggcacggctatggtcggtaagctgtttgcgccgatcatgctgacctggtttttgattctggcagggctggggttacgtagcattattgctaacccggaagtgctgcatgcactgaatccgatgtgggcggtgcatttcttccttgaatacaaaacggtttcttttattgcattaggggcagtggtgctgtcgattacgggggtcgaggcgctgtatgctgatatggggcactttggtaagttccctattcgtctggcgtggttcaccgtcgtattgccttccttaacccttaattacttcggccagggagcgctgttgttaaagaatccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacttccgaaatggagtcagggcaaatctatattccctttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattcccttgttcaccgctaacctcgataaactgctctccggcggctggttgccattgagcctcggtacggtgatgtttatcgtgatgaccacctggaagagcgagcgtttccgcttgctgcggcggatgcatgaacatggtaactctctggaagcgatgattgcttcgctggagaaatcaccgcccgttcgcgtgcctgggaccgcggtgtatatgtcgcgtgcaatcaacgtcattccctttgcgctgatgcataacctgaaacataacaaggtattgcatgagcgggtgattctgttaactctgcgcaccgaagacgcgccatatgtccataacgtccgtcgggtacagattgaacaactgtcgcccactttctggcgcgtggtggcaagttatggttggcgagaaacgccaaacgtggaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgggcaccggatcaatttgaaatcccgccaaacagagttatcgaactgggtactcaggtcgaaatctaacgccagacgcctcctttctccataagggggcgtttttgttttcatggttaatcaccatgtaaaacgtttcgaggttgatcacatttccgtaacgtcacgatggttttcccaactcagtcaggattaaactgcgggtcagcgaaacgtttcgctgatggagaaaaaaatgaaaaaaggcaccgttcttaattctgatatttcatcggtgatctcccgactgggacataccgatacgctggtggtgtgtgatgctggtttacccatccccaaaagtacaacgcgtatcgatatggcattaacccagggtgtaccttcttttatgcaggtgctgggtgtagtcacaaatgaaatgcaggtcgaggctgtcattatcgcggaagagatcaaacaacataatccgcaactccacgaaacgttgctcactcaccttgagcagctgcaaaaacaccagggaaacaccattgaaattcgttacaccacgcatgaacaattcaaacaacaaaccgcaggaagtcaggcggtaattcgcagcggagaatgttctccgtatgcgaatatcattctctgtgctggcgtgacgttctgaggccgtcatggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatactcgcgatgccggtacgcttttatggttggggaaagaaacgacatttaccgggccgaaatcttcccaggaagccgggattgggattatccaccaggaactgaacctgatcccgcagttaaccattgccgaaaacattttcctcggtcgtgagtttgttaatcgctttggcaaaattgactggaaaaccatgtatgccgaagcggataaattgctggctaaacttaacctgcgctttaaaagcgacaaactggtgggcgatctttccatcggtgaccagcaaatggttgaaatcgccaaagtgctgagctttgagtcgaaagtcatcattatggatgaaccgaccgatgcgctgaccgataccgaaaccgaatccttgttccgcgtcatccgcgagctgaaatcgcaaggccgcggtattgtctatatctcccaccgcatgaaagaaatcttcgagatttgcgatgacgttaccgtttttcgtgacggacaatttattgctgagcgcgaagtggcatcactgaccgaagattctctgattgagatgatggtgggccgcaagctggaagatcaatatccgcacctgaacaaagcgccgggagatatccgcctgaaagtcgataatctctgcggacctggcgttaacgatgtctcttttactttacgcaaaggcgaaattcttggcgtctctggtttgatgggcgctgggcgtaccgaactgatgaaagtgctctacggtgcactgccgcgcacaagcggttacgtcaccctggatgggcatgaagtcgttacccgttcgccgcaggatggcctggcaaacggcattgtttatatctccgaagaccgtaaacgtgacggtttagtgctgggcatgtcagtaaaagagaacatgtcgctgaccgcgctgcgctacttcagccgcgctggcggcagtttgaagcatgccgatgaacagcaggctgtgagtgatttcattcgtctgtttaatgtgaaaacgccatcgatggaacaggcaattggtctgctttccggtggcaatcagcaaaaagtagcgattgcccgtggtctgatgacacgccctaaagtgttgatcctcgatgagcctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaaaaaaatgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattcttcagcaaacctcggtgaacgccattatggcggtcgggatgacgctggtgatcctgacgtcgggtatcgacttgtcggtaggttctctgttggcgctgaccggcgcagttgctgcatctatcgtcggcattgaagtcaatgcgctggtggctgtcgctgccgctctcgcgttaggtgccgcaattggtgcggtaactggggtgattgtagcgaaaggtcgcgtccaggcgtttatcgctacgctggttatgatgcttttactgcgcggcgtgaccatggtttataccaatggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaatgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaataacgactacaggacatcttgaatatgaacatgaaaaaactggctaccctggtttccgctgttgcgctaagcgccaccgtcagtgcgaatgcgatggcaaaagacaccatcgcgctggtggtctccacgcttaacaacccgttctttgtatcgctgaaagatggcgcgcagaaagaggcggataaacttggctataacctggtggtgctggactcccagaacaacccggcgaaagagctggcgaacgtgcaggacttaaccgtccgcggcaccaaaattctgctgattaacccgaccgactccgacgcagtaggtaatgctgtgaagatggctaaccaggcgaacatcccggttatcactcttgaccgccaggcaacgaaaggtgaagtggtgagccacattgcatctgataacgtactgggcggcaaaatcgccggtgattacatcgcgaagaaagcgggtgaaggtgccaaagttatcgagctgcaaggcattgccggtacatccgcagcccgtgaacgtggcgaaggtttccagcaggccgttgctgctcacaagtttaatgttcttgccagccagcctgcagattttgatcgcaccaaaggtttgaacgtaatgcagaacctgttgaccgctcatccggatgttcaggctgtattcgcgcagaatgatgaaatggcgcttggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtagttttaatcaggttgtatgacctgatggtgacataaatacgtcatcgacagatgaacgtgtaatataaagaaaagcagggcacgcgccaccctaacacggtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaagctgtggctgctgggcgtagcggtgcgaataccgcgtttattgcctgtacgggtgatgacagcattggcgagagcgtacgtcagcagctcgccactgataacatcgatatttctccggtcagcgtgatcaaaggcgaatcaacaggtgtggcgctgatttttgttaatggtgaaggtgagaatgtcatcggtattcatgccggcgctaatgctgccctttccccggcgctggtggaagcgcaacgtgagcgtattgccaacgcgtcggcattattaatgcagctggaatcaccactcgaaagtgtgatggcagcggcgaaaatcgcccatcaaaataagactatcgttgcgcttaacccggctccggctcgcgaacttcctgacgaacttctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggcgcgttaatcacggcgttgctggaagaaaaaccattgccagaggcgattcgttttgcccatgcagccgctgcgattgccgtaacacgtaaaggcgcacaaccttccgtaccgtggcgtgaagagatcgacgcatttttagacaggcagaggtgacgcttggctacaatgaaagatgttgcccgcctggcgggcgtttctacctcaacagtttctcacgttatcaataaagatcgcttcgtcagtgaagcgattacagccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtcttgtcctttgcaataccgaaggcgatgaacagcggatgaatcgtaatctggaaacgctgatgcaaaaacgcgttgatggcttgctgttactgtgcaccgaaacgcatcagccttcgcgtgaaatcatgcaacgttatccgacagtgcctaccgtgatgatggactgggctccgttcgatggcgacagcgatcttattcaggataactcgttgctgggcggagacttagcaacgcaatatctgatcgataaaggtcatacccgtattgcctgtattaccggtccgctggataaaactccggcgcgcctgcggttggaaggttatcgggcggcgatgaaacgtgcgggtctcaacattcctgatggctatgaagtcactggtgattttgaatttaacggcgggtttgacgccatgcgccaactgttatcacatccgctgcgtcctcaggctgtctttaccggaaatgacgctatggctgttggcgtttaccaggcgttatatcaggcagagttacaggttccgcaggatatcgcggtgattggctatgacgatatcgaactggcaagctttatgacgccaccattaacaactatccaccaaccgaaagatgaactgggggagctggcgattgatgtactcatccatcggataacccagccggccctacagcaacaacgattacaacttactccgattctgatggaacgtggttcggcttagatttacgctgtcttttgatcaaattattaccatcggttgttttcagtagcatgaacattgctgctgaagcaacagtaataatgcccatcgtgataaacgtatagtggaattgttcgactgtcgttgtgccttccatcccttcgtaaacgcgaaggacggccgcacttacagcaacgcctaaactgatagacagttgctgcgtgaccgccagaacactgttaccgctgctggcgttgtcatcggtcagatcggcaagtgtgatggtattcatcgcggtaaattgtgtcgacatagccatccctaatataaacaacggcaagatcagcatccatatcgccattgctggtgattgcaaagagaactgagcgatcattagccctataatcaccgtgatccccactaacgtatggcgatagcccagacgacgtaagacttgggtaaccatcgattttgcaataatggaacctaacgctgtcggtgccatcatacagccagcaataaacgcctgatacccaaatcctacctgtaacatcaatggcataaggaacggtacacagccggttcccagacgggttgcaatattgcctacgataccgatcgagaaagtgcgggttttaaataaatctaatgaaattaatgggtttggcgtgcgtcgcgcatggagaatatagagaagcagtaacccgatgctggtgacaattaccgtcaaggcaatccagctggcgacaatcttttccccgaatagctctattccgcttgagaagagaacaaggctgaggccaaacagcaaaaagccagtggtatcgaatctgcgtcgtgcggtgatgaaattgggcatatgtttgtgcgcgtaaagaaggcccgcaatacctatggggatattgattaaaaatatccagtgccaggttgcctaggtgaccagcacgccgccaagaacggggcctaaaattggccccaccagacccggcatggcgacaaaattcaatacaggaagaagttcattacgaggataagcgcgcagtaaggccagccgagcaacaggcatcatcattgcgccgcctatcccctgaataacccggaagacaaccagctgtggtagcgagttggaaagtgcgcaggccagagaacccaacgtgaacagactcacggcaagggtaaaaatgcgacgtgtaccgaagcgatcggctagccatccgcttaccggaataagcatcgccaccgtcagcgtataactgatgatggctgattgcatcgcgagaggagaacgattaaggctatgagcgattgcgggtaaggcggtattcagaatagtggcatcaagtgcctgcatgaagaaggccatcgccgcgatccacggcaaacccgccatactgcgcttctttttatcgctcattcaatgtcctgttatcgggttatcacttatctggtgagcgtagcagcgcctgacaagctttaaatgccgcgtcgccatcgctttggataatcgcatcgacaatcgcctggtgcagatccagctttatcactgtgtcgctggtaattgacgtgaagtaagtgtgataaaccgaatggaatagcgaggcgaatgaggtcaaaaacggattggcgctcatttcatagatatgctcatgccaggccatatcgacttcgatccagcgttcacggcgaaagttctcttttaatgccgccatttcggccattaacgtattgagatgcgccttctgttccgcggtgccaacctttgctgccagtaggcaagcttgcggctccagacagatacgcataaccagaaagtgatcgatgacctgatgaaagttctcttctgtcatccaccaggtaagcaattcctgatcaagaaaattccagttcgattgtggcatgactcgggtaccaattcgcggtcgcggtaaaaccatcccttttgccgttaacgttttgaccgcttcgcgtaccgctgtacgactcactccaaattgctcgcccagctcaatctcaccaggcaaaatggtgccgggttcatattcaccttttaagatccgctgcgccagcttctcagccagaacatacgaaaggtttttctgtgcagctaactgttgtgcgcttaaaggcattacnnnnncattccattcattaattaattaatgaatgaatgnnnnncgaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgcagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctctttatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggtaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcggattgagagaagattttcagcctgatacagattaaatcgacaggtcagaacaggacgtgttgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaatttagcagtaagccggttataaaccggtggttgtaaaagaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaatcatccttagcgaaagctaaggattttttttatctgaaataaccctctccgaagtaactccttctaccggcatccttgccagccattcagattaatacacttcatccagcacgttaattttcaatagatcgcgaatcaacgcatttttatcgctattttgtagccatatggcataaagcggccgtgaaagtgttgtgctatcgacaacggtatgcaggccgccttttttacgtgcccaactgacgggtagccaggtgcaaccattaagcatcgcaatctgttgctgtgccagttcagcagaactggttgtcagaatgggaacttcgtcagcaccgatcaaacctgcctcatgctgttgaaaatctggcccccactctagtcgcagatagttaagatctccctttagtttagaaggggcactggtataaagcgctaaagtgaaataccccagcaactgactacaaaattcgtccattttgggggcttcagttgtaataagaagatcaagctggcgttcatgcaactgttttaccagagactgccgttgggcaattcgcgcttcgaactgtaagcctgtatggacatcctgattttgatacaagcgtcccagccactgattaagcatacactcccacagcgaggcgctggcaccgatagaaaactcattatgtcgtgaggtatgcgccacctccttgcgggcggcctgccaggtgctcatgagcgtttctgcataaggcagaagcttttctccggcagcggttaaacggatattgtttctgtggcgggtgaaaagattcacacccagttgattttccagttgtctgattcgaaagctcacggctgattgggtcagatagagcgattcagccgctcgaccaaagtgacgcgttcggctaacttccaggaaagtttttaacaattccgtatccacagtgctctccgcaaaattatttgtcgttatgatttaaatgttttgttttacactctgtcaagcgtaactaatactccgcgccataactagctcggtcaaagaattaggagcgtgcaggatggcggaaagctttacgacgactaatcgatatttcgacaataaacattatccacgtggattctctcgtcatggtgacttcaccatcaaagaggcacaactgcttgagcgtcatggttatgccttcaatgagttggatcttggcaaacgcgagccggttaccgaggaagagaaactcttcgtagcagtatgccgtggcgaacgtgaaccagtgacagaagcagaacgcgtgtggtccaagtatatgacgcgtatcaagcgtccaaaacgttttcacaccctttccggcggtaaaccgcaggttgaaggtgctgaagactacaccgattctgacgattaataaaaagggcgaaatgccctttttttatgtcagtagtttttgcagatggatgagcaaacggtcaatcgcacgatagctaactgcctcctgcaaatgctgacgtgtgataatgtcagactgatcaatatcagcaatggttcgtgcaactttcaataaccgctgccaggcacgaatcgataaccccagatggatcagcgtttcttccagccactgcgcatcttcgctttcaagcttgcagaattggcgtatttccggattatccagccaggcgttcagtttattctgccgcttaaattggcgctctctggcggccattacacgttgtttaacggtggtgctgttttctcccggcactaccgttttactcaaaatgccggggggcggtaatgggatctccagtgagagatcgaagcggtcgagaaagggccccgagagccggttgagataacgtaatgtctgttctggtgtgcagcggttatggtttccctgataatgtccggtagggctgggattcattgccgcgacaagctggaaacgggctggataggttatttttgctcgtgtgcgtgaaagatggatctgcccggattcaatcggctctcgcaaggcatccagtgtacgccgttcaaattcaggtagctcatcaagaaaaagcacgccgttatgcgccagcgaaatttcacctggccctggaattgcaccaccgcccaccatcgcagttaacgacgcactgtgatgaggtgagcggaacgggcgctgccgccattgtttttgtactgattcagcatttaccagacttaatatcgcagcgctctccagtgcctcttcattgcttaaatctggcaaaaggccattaatacggctggcgagcattgttttacctgttcccggcggtccaatcagtaaaaggttgtgcccgccagcggcggtaatttccagtcctcgctttccttgctcctgaccgacaacatcactgagatcatgttgtagcgcccgggatactgcattagttggtttcgggtgttcgagagcgtgcttaccttccagaaacgcgcagacagcctgcagatgatcggctatcaggcatccttcaccgttaattagccccacttcatcttcgttatctttcgcgacgataatttttctgcccgacttaatagcttcagttgcactggagattgcgccgggaacgccacgcagagcgcctgtaagcgccagttctccgactaattcatattcatctaacttattggctgtaagctgttctgaggccgccagtaacgcaatagcgataggcaaatcatatcgtcccccttcttttggcagatcggctggagcaaggttgatggtgatttttttcgccggatattcatatccgctattgataatggcgctgcgcacgcgatcgcgagcttcttttaccgttgtttctggtaagcccaccatcgttaagcctggtagacctttactgatatgtacctcaacagtgattgggggcgcatttactcccagggctgcgcgggtatgaacaattgacagtgacataagccctccttgagtcaccattatgtgcataagatatcgctgctgtagcccgctaattcgtgaattttagtggctgattcctgtttatttgtgcaagtgaagttgagttgttctggcggtggaatgatgctcgcaaaaatgcagcgtgcaaaggatgaactacgaggaagggaacaacattcatactgaaattgaatttttttcactcactattttctttttaaaaaacaacaatttctcttgaaattattaaagacatcataaaaatcggccaaaaaatatcttgtgctattcgcaaaatctatggtaactctttaggcattccttcgaacaagatgcaagaaaagacaaaatgacagcccttctacgagtgattagcctggtcgtgattagcgtggtggtgattattatcccaccgtgcggggctgcacttggacgaggaaaggcttagagatcaagccttaacgaactaagacccccgcaccgaaaggtccgggggttttttttgaccttaaaaacataactgaggagcagacaatgaataacagcacaaaattctgtttctcaagattcaggacggggaactaactatgaatggcgcacagtgggtggtacatgcgttgcgggcacagggtgtgaacaccgttttcggttatccgggtggcgcaattatgccggtttacgatgcattgtatgacggtggcgtggaacacttgctgtgccgacacgagcaaggtgcagcaatggcggctatcggttatgcccgtgctaccggcaaaactggcgtttgcatcgccacgtctggtccaggtgcaaccaacctgataaccgggcttgcggacgcgctgttagattccatccccgttgttgctatcaccggtcaggtatccgcaccgtttatcggcactgacgcatttcaggaggtggatattctggggttgtcgttagcctgcaccaagcacagtttcctggtgcaatcactggaagagttaccgcgtatcatggccgaagcgtttgacgtcgccagctctggtcgtcctggtccggttttggtcgatattccaaaagatatccagttagccagcggcgatctggaaccgtggttcaccactgttgaaaacgaagtgactttctcacatgccgaagtcgagcaagcgcgtcagatgctggcaaaagcgcaaaaaccgatgctgtacgttggcggtggcgtgggcatggcgcaggcagtttcggctttgcgtgaatttctcgctgccacaaaaatgcctgccacctgtacgttgaaagggctgggcgcagtagaagcagattatccgtactatctgggcatgctggggatgcacggcaccaaagcggcgaacttcgcagtgcaggagtgcgatctactgatcgccgtgggcgcacgttttgatgaccgggtgaccggcaaactgaacaccttcgcaccacacgccagcgttatccatatggatatcgatccggcagaaatgaacaagctgcgtcaggcacatgtggcattacagggtgatttaaatgctctgttaccagcattacagcagccgttaaatatcgatgactggcagcaacactgcgcgcaactgcgtgatgaacatgcctggcgttacgaccatcctggtgacgctatctacgcgccgttgttgttaaaacaactgtcggatcgtaaatctgcggattgcatcgtgaccacagatgtggggcagcaccagatgtgggctgcccagcacatcgtccacactcgcccggaaaacttcatcacctccagcggcttaggcaccatgggtttcggtttaccggcggcggttggcgcacaagtcgcgcgaccgaacgatactgtcgtctgtatctccggtgacggctctttcatgatgaatgtgcaagaactgggcaccgtaaaacgcaagcagttaccgttgaaaatcgtcttactcgataaccaacggttagggatggttcgacaatggcagcaactgtttttccaggaacgatacagcgaaactacccttaccgataaccccgatttcctcatgttagccagcgccttcggcatccctggccaacacatcacccataaagaccaggttgaagcggcactcgacaccatgctgaacagtgatgggccatacctgcttcatgtctcaatcgacgaacttgagaacgtctggccgctggtgccgcctggtgccagtaattctgaaatgttggagaaattatcatgatgcaacatcaggtcaatgtatcggctcgcttcaatccggaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgctatctgccagagcacaaccacatcacaacaaatccgcgcctgagcgcaaaaggaatataaaaatgaccacgaagaaagctgattacatttggttcaatggggagatggttcgctgggaagacgcgaaggtgcatgtgatgtcgcacgcgctgcactatggcacctcggtttttgaaggcatccgttgctacgactcgcacaaaggaccggttgtattccgccatcgtgagcatatgcagcgtctgcatgactccgccaaaatctatcgtttcccggtttcgcagagcattgatgagctgatggaagcttgtcgcgacgtgatccgcaaaaacaatctcaccagcgcctatatccgtccgctgattttcgtcggtgatgttggcatgggcgtaaacccgccagcgggatactcaaccgatgtgattatcgccgctttcccgtggggggcgtatctgggcgcagaagcgctggagcaggggatcgatgcgatggtttcctcctggaaccgtgctgcaccaaacaccatcccaaccgcagcgaaagctggaggtaactacctctcttccctgttggtgggtagcgaagcgcgccgccacggttatcaggaaggtatcgcattggatgtgaatggttatatctctgaaggcgcaggagaaaacctgtttgaagtgaaagacggtgtgctgttcactccaccgttcacctcctccgcgctgccgggtattacccgtgatgccatcatcaaactggcgaaagagctgggaattgaagtgcatgaacaggtgctgtcgcgcgaatccctgtacctggcggatgaagtctttatgtccggtacggcggcagaaatcacgccagtgcgcagtgtagatggtattcaggttggtgaaggccgttgcggcccggttaccaaacgcattcagcaagccttcttcggcctcttcactggcgagaccgaagataaatggggctggttagatcaagttaatcaataaatacaaaaaatgggacggcacgcaccgtcccatttacgagacagacactgggagtaaataaagtatgcctaagtaccgttccgccaccaccactcatggtcgtaatatggcgggtgctcgtgcgctgtggcgcgccaccggaatgaccgacgccgatttcggtaagccgattatcgcggttgtgaactcgttcacccaatttgtaccgggtcacgtccatctacgcgatctcggtaaactggttgccgaacaaattgaagcggctggcggcgttgccaaagagttcaacaccattgcggtggatgatgggatcgctatgggccacgggggcatgctttattcactgccatctcgcgaactgatcgctgattccgttgaatatatggtcaacgcccactgcgccgacgccatggtctgcatctctaactgcgacaaaatcaccccggggatgctgatggcttccctgcgcctgaatattccggtgatctttgtttccggcggcccgatggaggccgggaaaaccaaactgtccgatcagatcattaagctcgatctggttgatgcgatgatccagggcgcagacccgaaagtttctgactcccagagcgatcaggttgaacgatccgcctgcccaacctgcggttcctgctccgggatgtttactgctaactcaatgaactgcctgaccgaagcgctgggcctgtcgcagccgggcaacggctcgctgctggcaacccacgctgatcgcaagcaactgttcctcaatgctggtaaacgcattgttgaattgaccaaacgttactacgaacaggatgatgaaagcgcactgccgcgtaacatcgccagtaaggcggcgtttgaaaacgccatgacgctggatatcgcgatgggcggctctaccaacaccgttctccacctgctggcggcggcgcaggaagcggaaatcgacttcaccatgagtgatatcgataagctctcccgcaaagtaccgcagctgtgtaaagttgcgccgagcacccaaaaataccatatggaagatgttcaccgtgctggtggtgttatcggtattctcggcgagctggatcgtgcggggttactgaaccgtgatgtgaaaaatgtacttggcctgacgttgccgcaaacgctggaacaatacgacatcatcgtgacccaggatgatgcggtaaaaaatatgttccgcgctggcccggcgggcattcgtactacacaggcattctcgcaggattgccgctgggatacgctggacgacgatcgctccaatggctgtatccgctcgctggaacacgcctacagcaaagacggcggcctggcggtgctctacggtaatttcgcagaaaacggctgcatcgttaaaaccgcaggcgtcgatgacagcatcctcaaattcactggcccggcgaaagtctacgaaagccaggacgacgcggtagaagcgattctcggcggtaaagttgtcgccggagatgtggtagtaattcgctatgaaggcccgaaaggcggtccggggatgcaggaaatgctctacccaaccagtttcctgaaatcaatgggtctcggtaaagcctgtgcgctgatcaccgacggtcgtttctctggcggcacctctggtctttccatcggccacgtctcaccggaagcggcaagtggcggcagcattggcctgattgaagatggtgacctgatcgctatcgacattccgaaccgtggcattcagttacaggtaagcgatgccgaactggcggcgcgtcgtgaagcgcaggaagctcggggtgacaaagcctggacgccgaaaaaccgtgaacgtcaggtttcctttgcgctgcgtgcctacgccagcctggcaaccagcgccgacaaaggcgcggtgcgcgataaatcgaaactggggggttaatgatggcagactcacaacccctgtccggtgcccctgaaggtgccgaatatttaagagcggtgctgcgcgcgccggtctacgaagcggcgcaggtcacgccgctacaaaaaatggaaaaactctcgtcgcgtctcgataacgtgattctggtgaaacgcgaagaccgtcagccagttcatagctttaagctgcgcggcgcatacgccatgatggcgggcctgacggaagaacagaaagcgcacggcgtgatcaccgcttctgcgggtaaccacgcgcagggcgtcgcgttttcttccgcacggttaggcgtgaaggcactgatcgtcatgccaaccgccaccgccgatatcaaagtcgacgcggtgcgcggcttcggcggcgaagtgcttcttcacggcgcgaactttgatgaagcaaaagcgaaagcgatcgaactgtcacagcagcagggcttcacctgggtgccgccgttcgaccatccgatggtgatcgccgggcaaggcacgctggcgctggaactgctccagcaggacgcccatctcgaccgcgtatttgtgccagtcggcggcggcggtctggcggcgggcgtggcggtactgatcaaacaactgatgccgcaaatcaaagtgattgccgtggaagcggaagactccgcctgcctgaaagcggcgctggatgcaggtcatccggttgatctgccacgcgtggggctgtttgccgaaggtgttgcggtgaaacgcatcggcgacgaaaccttccgtttatgccaggagtatctcgacgacatcatcaccgtcgatagcgatgccatatgtgcggcgatgaaagacctgttcgaagatgtgcgcgcggtagcggaaccctctggcgcgctggcactggcgggaatgaaaaaatatatcgcccagcacaacattcgcggtgagcggctggcgcatattctttctggtgctaacgtgaactttcacggcctgcgctacgtctcggaacgttgcgaactgggcgaacagcgtgaagcgttgctggcggtaaccatcccggaagagaagggcagcttcctgaagttctgccagctgcttggcgggcgctcggtcaccgagttcaactaccgttttgccgatgccaaaaacgcctgcatttttgttggtgtgcgcctgagccgtggtctcgaagagcgcaaagaaattttgcagatgctcaacgatggcggctacagcgtagtggatctctccgacgacgaaatggcgaagctgcatgtgcgctatatggtcggcgggcgtccgtcgcatccgttgcaggaacgcctctacagcttcgaattcccggaatcgccgggcgcgctgttgcgcttcctcaacacgctgggtacgcactggaacatttctttgttccactatcgcagccatggcaccgactacgggcgcgtactggcggcgttcgaacttggcgaccatgaaccggatttcgaaacccggttgaatgagttgggttacgattgccacgacgaaaccaataacccggcgttcaggttctttttggcgggttaatggttcggcaaaatcttccagaacgcctcaatcagcggctcatgcagccgctttttctgcgcacagacgcccagttcaaaaggtgttttctcatcactgcgctctaaaatcatcacgcggttacgcactggttccgggctgttttccagcaccacttccggcaacaaggccacgccacagccgagcgctaccatcgacaccatcgcttcatgcccgccgaccgtggcgtaaatcatcgggttgctgattttgttgcgtcgaaaccacagttcaatgcgccggcgcaccggtccctgatcggccatgataaacggcactgtagaccagtccggcttctctgccgaaacttggttacgcaccgggcagggtagcgcgggggcaatcagcactactgccagattctccagcatcgaaaacgccactgcgccgggcagagtctccggtttcccggcaatcgccagatccgcttcgccagtgactaccttttccatcgcatctgccgcatcaccagtcgtgagtttaatctccaccgacgggtgttccgcgcggaagcgatcgagaatcggcggcagatggctgtaggcagcggtcaccgagcagaagatatgtaattcgccagagagcgacggtccttgctgatcgatggtgtggcgcagctgttgatactgcaacagcgtttgctgggcgaaaacgcgcagttcttcgcctgcttcggttagcgttaccgtgcggttatcgcgcacaaacagcggctgaccgagatcgtcttccaggcgctgaatctgccgagagagcgtggacgggctaacgtgcattgcccgcgcgctgcggccaaaatggcggctttccgccagatgcaggaaggttttcagatcgcgtaaatccaatggcgcagcccttaatgttgacgttgcagaaattgcaatgtgacgttgtgaatatatcaatttccgcaataaatttcctgtcatatagtgaattcaatctcgcaaacgcgaaccgaacaataagaagcacaacatcacgaggaatcaccatggctaactacttcaatacactgaatctgcgccagcagttggcacagctgggcaaatgtcgctttatggggcgcgatgaattcgccgatggcgcgagctaccttcagggtaaaaaagtagtcatcgtcggctgtggtgcacagggtctgaaccagggcctgaacatgcgtgattctggtctcgatatctcctacgctctgcgtaaagaagcgattgccgagaagcgcgcatcctggcgtaaagcgaccgaaaacggcttcaaagttggcacttacgaagaactgatcccgcaggcggatctggtggttaacctgacgccagacaagcagcactctgacgtagtgcgttccgttcagccgctgatgaaagacggcgcggcgctgggctactctcatggtttcaatatcgtagaagtgggtgagcagatccgtaaagacatcaccgtcgtaatggttgcgccgaaatgccctggcaccgaagtacgtgaagagtacaaacgtggattcggcgtaccgacgctgattgccgttcacccggaaaacgatccgaaaggcgaaggcatggcgatcgctaaagcatgggcggctgcaaccggcggtcaccgtgcgggcgttctggaatcctctttcgttgcggaagtgaaatctgacctgatgggcgagcaaaccatcctgtgcggtatgttgcaagctggttctctgctgtgcttcgacaagctggtggaagaaggcaccgatccggcatacgcagaaaaactgattcagttcggttgggaaaccatcaccgaagcgctgaaacagggcggcatcaccctgatgatggaccgtctttctaacccggcgaaactgcgtgcttacgcgctctctgagcaattgaaagagatcatggcgccgctgttccagaaacatatggacgacatcatctccggcgaattctcctccggcatgatggctgactgggccaacgacgataagaaactgctgacctggcgtgaagagactggcaaaaccgcattcgaaaccgcgccgcagtatgaaggcaaaatcggcgaacaggagtacttcgataaaggcgtactgatgatcgcgatggtaaaagcaggcgttgagttggcgtttgaaaccatggttgattccggcatcatcgaagaatctgcttactatgaatcactgcacgaactgccgctgattgccaacaccatcgcccgtaagcgtctgtacgaaatgaacgtggttatctccgatactgccgagtacggtaactatctgttctcttacgcttgtgtgccgctgctgaaaccgtttatggcagagctgcaaccgggcgacctgggtaaagctattccggaaggtgcggtagataacgcgcaactgcgtgatgtaaatgaagcgattcgcagccatgcgattgagcaggtaggtaagaaactgcgcggctatatgacggatatgaaacgtattgctgttgcgggttaatagcgattcagagttcaaggccttctcccggagaaggccttgctgttagttacggtacagcaccttaatgatgtggtaaccgaactgggtatgcagcgggccggttggctccagtaccggacaagagaaaaccactttatcgaacgccggaaccatttgaccctggcggaattcacccaaatcaccgccgcgtttgcctgacgggcaaatggagtgtttcttcgccagcttgccgaaatcggcaccattcttgatctgctcgagaagatccagagccagtttctcttcttttacaaggatatgcagtgctgctgctgtttttgccatgatcgtgccttgagtggtaaggatgaggctggctatactaccacgctgttattttcccctcccgactttcattgagcgattttcctatgcgtctaaaccccggccaacaacaagctgtcgaattcgttaccggcccctgcctggtgctggcgggtgcgggttccggtaagacgcgagtgatcaccaataaaatcgctcacctgattcgcggttgcggttatcaggcgcggcatattgcggcagtcacctttaccaacaaagcggcgcgcgagatgaaagagcgtgtggcgcagacgctggggcgcaaagaggcgcgagggttgatgatctccaccttccacacgcttgggctggatattatcaagcgcgaatatgcggcgttggggatgaagtctaacttttcgctgtttgacgataccgatcagcttgctttgcttaaagagttgaccgaggggctgattgaagatgacaaagttctcctgcaacagctaatttcgaccatctccaactggaagaacgatctcaaaacaccggcgcaggcggcggcagaggcaaagggcgagcgggaccgtatttttgcccattgttatgggctgtatgatgcacacctgaaagcctgtaacgttctcgacttcgatgatctgattttattgccaacgttgctgctgcaacgcaatgaagaagtccgcgagcgctggcagaacaaaattcgctacctgctggtggatgagtatcaggacaccaacaccagccagtatgaactggtgaaactgctggtgggcagccgcgcgcgctttaccgtggtgggtgacgatgaccagtcgatctactcctggcgcggcgcacgtccgcagaatctggtgctgctgagccaggattttccggcgctgaaggtgattaagcttgagcagaactaccgctcttccggacgtattttgaaagcggcgaacatcctgatcgccaataacccgcacgtctttgaaaagcgtctgttctccgaactgggttacggcacagagctaaaagttttaagcgcgaataacgaggaacatgaagccgagcgcgtcaccggcgagctgatcgcccatcacttcgtcaataaaacgcagtacaaagattacgccattctttatcgcggcaaccatcagtcgcgggtatttgaaaaattcctgatgcaaaaccgcatcccgtacaaaatatctggcggtacgtcgtttttctctcgtcctgaaatcaaggacttgctggcttatctgcgcgtgctgactaacccggacgatgacagcgcatttctgcgtatcgttaacacgccgaagcgagagattggcccggcgacgctgaaaaagctaggtgaatgggcgatgacgcgcaataaaagcatgtttaccgccagctttgatatgggcctgagtcagaccctgagcggacgtggttatgaagcattgacccgcttcactcactggttggcggaaatccagcgtctggcggagcgggagccgattgccgcggtgcgtgatctgatccacggcatggattatgaatcctggctgtacgaaacatcgcccagcccgaaagccgccgaaatgcgcatgaagaacgtcaaccaactgtttagctggatgacggagatgctcgaaggcagcgaactggatgagccgatgacgctcacccaggtggtgacgcgctttactttgcgcgacatgatggagcgcggcgagagcgaggaagagctggatcaggtgcaactgatgactctgcacgcgtcgaaagggctggagtttccctatgtctacatggttggtatggaagaagggtttttgccccaccagagcagcatcgatgaagacaatattgatgaggagcggcggctggcctatgtcggcattacccgcgcccagaaggaattgacctttacgctgtgtaaagaacgccgtcagtacggcgaactggtgcgcccggagccgagccgcttcctgctggagctgccgcaggatgatttgatttgggaacaggagcgcaaagtggtcagcgccgaagaacggatgcagaaagggcaaagccatctggcgaatctgaaagcgatgatggcggcaaaacgagggaaataatcaaggccggaaaagatgtgtcagcatcgcatccggcacttactcattaatgcacttccagcggccagtggacatagctctgccactggctttcctgatcaataatctctttacccagcggatgttgggttagccaaccttgcggaagcgtcaaggtcaacagttcatggttagcctgtaatgtcatctctggcacgagatcgtcacggcgacggctggcaaaaatgatagccaggcggagtaaacggcagagttgttctgcgacgcgcggtggtacggcattttgctgatgcagcgatgagagatcgaccggattagtctggttgagcagtagcgtcgccagcagttttttctgtgcgggggtaaaaccgggaagatctaggttacgcaccagataagcagcgtgttgcggcgcttgtttgaagtcaacgctcaggccgatttcatgaagctgacaggcgctgatgagcaaatcgcggcttattgcttcaagatgccattcattttccacctgatcgaagaagttagccgcaaccttggctacgcgctgtgcctgatcaatatcgatcataaagcggcgctgaatattacgcagcgtacggctgcgaatatcctgctcgacggtaagatgcaacataccgtagaccaggccttcacgcagcgcaccgcccgccagggtcatacactgaatattcagttcggtaaaaatggctatcaggatcgccagaccactcgggaacactaacgcacgttccagcgtcagcccgtcaatctctagctcttccagccgaccgcaatgaatggcgcgttgtttcagttgctgcaacttttccagggtaatgcgttcatccatcccctgtgccatcatgatttcctgtaacgcctgcacggtgccggaagcgccaacgcacactttccagccgtgataccgtaattcatcggcaaccggacgtaacacttcgcgtgccgctttttctgcagcatcaaaattttcctgccccagattacgatcggcaaaatagcgttccagccaggtaacgcagcccatcgacaggctgaacaaagaggtggtttgtgcacccgtgccggttaccagttcagtactggctccgccgatatccaccaccaggcgctgatcggcaccgccagtggtgtgagcaacgccctgataaatcagacgcgcttcctcttcaccgctgatcacctgtaccggacaaccgaggatttcctgcgctttggcaataaaatcacccgcattgacggcaagtcgtaatgtcgccgtagcgacaacgcgaatttgcgagggagggatatcttgcagacgttcagcaaacaggcgcagacattgccaaccgcgctccattgcttcattagacagggcattttcgctattcaggccggcagccagacgcactttgcgttttattcgcgtcagcgtctggatgcttccagccacctcgcgcacaaccagcatatgaaaactattcgaaccgagatcaatggctgcatacagcgacgaggtggaacccatactcttcatccttcaatctgtctctgcgttggctgcattccttcacctgaatcacttacgacagtaagcgcatcgggattcattctcttgccatcttgatacagcttgagtgatttggagtatgacattttttctttaacctgaacgacgacgattacgcggagcgccagtacgacgcggaccattgcctgtgcgcgggcgcgtgaggcgcagcggttttggcagatcggtcatcaatgcgtccggattgtatttacttaccggaattgagtgaccaatataggtctcaatagcaggcaaattcaatgcatactcttcacacgccaggctaatagagtgaccgcttgcgcctgcgcgacctgttcgaccaatacggtgaacgtaatcttcacagtcatcgggtaaatcgtagttaaagacgtgtgtcacagcaggaatatgcaaaccacgcgcggcaacgtcggtggcaaccagaatatccagatccccacgggtaaattcatcaagaatacgcagacgttttttctgcgcgacatcgcctgtcaataaaccgacacgatgaccatctgccgccaggtggccccagatctcttcacaacggtgtttggtgttggcgaaaataatcgctctgtctggccactcttcttcgatcagcgtttgcagcaaacgcattttttcttcgttagaagggtagaaaagctcttctttaatacgatggcccgttttctgttccggttccacttcaatatattcggcattgttcatctgctcgaacgccagttcacgtacccggtacgaaagcgtggcggagaacagcatgttgaggcgctggtttgcaggcggcatacggcggaacagccagcggatatctttaataaagcccagatcgtacatgcgatcggcttcgtccagtaccaccacctgaatggcaccgaggttaatgtggttctgcttggcgtagtcaattaaacgacccgtggtgccaatcagaatgtcaacgccgctttccagcactttcagctgtttgtcgtagccatcaccaccgtaagccagacccagcttcaggccagtagcttccgccagtggttccgcgtcggcatggatctgcacggcaagttcacgcgtcggtgccataattaaggcacgcggttgattcaccttgcgatcggcaatcgcgggatgagagagaagataatgaaacgttgacgtaagaaacgccatcgttttcccggtaccggtttgcgcctgcccggctacgtcacgacccgccagcgtcagcggaagggccagtgcctgaatgggcgtacagttatgaaacccttttttttcaagggcttctacaaccttcggatgcagggcgaagtcggaaaacttctgttctgttaaatgtgttttgctcatagtgtggtagaatatcagcttactattgctttacgaaagcgtatccggtgaaataaagtcaacctttagttggttaatgttacaccaacaacgaaaccaacacgccaggcttattcctgtggagttatatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggcgcactgtctaaaggtcagttgaaagagttcctcgacgctaacctggcgtaagggaatttcatgttcgggtgccccgtcgctaaaaactggacgcccggcgtgagtcatgctaacttagtgttgacttcgtattaaacataccttattaagtttgaatcttgtaatttccaacgcttcccgttttatcttaaatgcgaagtgaacagatttctggctcgtcactcaatccgtcttgtcgtttcagttctgcgtactctcctgtgaccaggcagcgaaaagacatgagtcgatgaccgtaaacaggcatggatgatcctgccataccattcacaacattaagttcgagatttaccccaagtttaagaactcacaccactatgaatcttaccgaattaaagaatacgccggtttctgagctgatcactctcggcgaaaatatggggctggaaaacctggctcgtatgcgtaagcaggacattatttttgccatcctgaagcagcacgcaaagagtggcgaagatatctttggtgatggcgtactggagatattgcaggatggatttggtttcctccgttccgcagacagctcctacctcgccggtcctgatgacatctacgtttcccctagccaaatccgccgtttcaacctccgcactggtgataccatctctggtaagattcgcccgccgaaagaaggtgaacgctattttgcgctgctgaaagttaacgaagttaacttcgacaaacctgaaaacgcccgcaacaaaatcctctttgagaacttaaccccgctgcacgcaaactctcgtctgcgtatggaacgtggtaacggttctacggaagatttaaccgctcgcgtactggatctggcatcacctatcggtcgtggtcagcgtggtctgattgtggcaccgccgaaagccggtaaaaccatgctgctgcagaacattgctcagagcattgcttacaaccacccggattgtgtgctgatggttctgctgatcgacgaacgtccggaagaagtaaccgagatgcagcgtctggtaaaaggtgaagttgttgcttctacctttgacgaacccgcatctcgccacgttcaggttgcggaaatggtgatcgagaaggcgaaacgcctggttgagcacaagaaagacgttatcattctgctcgactccatcactcgtctggcgcgcgcttacaacaccgttgttccggcgtcaggtaaagtgttgaccggtggtgtggacgccaacgccctgcatcgtccgaaacgcttcttcggtgcggcgcgtaacgtggaagagggcggcagcctgaccattatcgcgacggcgcttatcgataccggttctaaaatggacgaagttatctacgaagagtttaaaggtacaggcaacatggaactgcacctctctcgtaagatcgctgaaaaacgcgtcttcccggctatcgactacaaccgttccggtacccgtaaagaagagctgctcacgactcaggaagaactgcagaaaatgtggatcctgcgcaaaatcattcacccgatgggcgaaatcgatgcaatggaattcctcattaataaactggcaatgaccaagaccaatgacgatttcttcgaaatgatgaaacgctcataaatttgtcttatgccaaaaacgccacgtgtttacgtggcgttttgcttttatatctgtaatcttaatgccgcgctggcgatgttaggaaaattcctggattttgctggtgtgttatgcaatttgcatatcaagtagttaattttcgcatagtgctggtaggttcggaacggactttcctttctgaataaaggtcttcgtggttatacttctgctaataattttctctgagagcatgcattgtgaatttactgacagtgagtactgatctcatcagtatttttttattcacgacactgtttctgttttttgcccgtaaggtggcaaaaaaagtcggtttagtggataaaccaaacttccgcaaacgtcaccagggattgatacctctcgttggggggatttcggtttacgcagggatttgcttcacgttcggaattgtcgattactatattccgcatgcatctctctatctcgcttgtgctggtgtgcttgttttcattggcgcgctggatgaccgttttgatatcagcgtaaaaatccgtgccaccatacaggccgctgttggcattgttatgatggtgttcggcaaactttatctcagtagcctgggttatatctttggctcctgggagatggtgctcggaccgtttggttacttcctgacgctatttgccgtctgggcggccattaatgcgttcaacatggttgatggcattgatggcttgctgggcgggttgtcctgcgtctcgtttgcagcaatcggtatgattttgtggttcgacgggcaaaccagtctcgcaatctggtgctttgcgatgatcgccgccatcctgccatacatcatgcttaaccttggtatcctgggtcgccgctacaaagtctttatgggggatgcgggcagtacgctgattggttttaccgttatctggatcctgctcgaaacgacccagggcaaaactcatcccatcagcccggttaccgctttgtggataatcgccattccgctaatggatatggtggcgattatgtaccgtcgcctgcgtaaaggcatgagcccattctctccagaccgtcagcatattcaccatttgatcatgcgtgccgggtttacttcccgccaggcgtttgtgctgattacccttgccgcagcactgctcgcttccattggcgtgctggcagaatattctcattttgtcccggagtgggtcatgctggtgctctttttgctagcattcttcctctatggatattgcattaagcgtgcctggaaagttgctcgctttattaagcgcgtaaaacgcagactgcgtagaaatcgtggtggcagccccaatttaaccaaataaatgaggatgtgatgacacaaccaatgcctgggaaaccggccgaagacgctgaaaatgaactggatattcgtgggttgtttcgtaccttgtgggctgggaagctgtggattattggcatggggctggcgtttgcgttaatcgcgctggcgtatactttttttgctcgccaggagtggagctcgacagcgattaccgatcgtccaacggtgaatatgctggggggatattactcacagcagcaatttttgcgtaacctggatgtccgttcaaacatggcttctgccgaccaaccatcggtcatggacgaagcctataaagagtttgttatgcaactggcctcgtgggatacccgcagagagttctggctgcaaaccgactattacaaacagcggatggtgggcaatagcaaagccgatgcggcgttgctggatgaaatgattaacaacatcgtgtttattcccggtgactttacccgcgcggtcaatgacagcgtgaagcttattgccgaaaccgcgcctgacgctaataacctgttacgtcagtatgttgcttttgccagccagcgtgcagccagccatctgaatgatgagctgaaaggcgcatgggcggcacgcaccatccagatgaaagctcaggtgaagcgtcaggaagaggtggcgaaagccatctacgatcgccggatgaacagtattgaacaggcgctgaaaattgctgagcagcataatatttcgcgcagtgcgacagatgtgcctgccgaggaattacctgattcagaaatgttcctgcttgggcgtccaatgctccaggctcgactggaaaatttacaggccgtcggtccggcctttgatctcgactatgatcaaaatcgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcggggggctgatcggggctggtgtcgcattaacccgccgttgctcgaaatagcaacactgctgcggtgagcgcaaaggcgctcgccgcttattcgaagagaatcgatgtgaaagtactgactgtatttggtacgcgcccggaagccatcaagatggcaccgttggtgcatgcgttggcaaaagatcctttttttgaggctaaagtttgcgtcactgcgcagcatcgggagatgctcgatcaggtgctgaaactcttttccattgtacctgactacgatctcaacataatgcagccaggacagggccttacagagataacctgtcggattctggaagggctaaaacctattcttgccgagttcaaaccagacgtcgtgctggttcacggcgatactactacaacgctggcaaccagcctggcggcgttttatcagcgtattccagttggtcacgttgaggcaggtctgcgcacgggcgatctctattcgccgtggccggaagaggctaaccgtacattgaccgggcatctggcgatgtatcacttctctccaaccgaaacttcccggcaaaacttgctgcgtgaaaacgttgctgacagccgaatcttcattaccggtaatactgtcatcgatgcactgttatgggtgcgtgaccaggtgatgagcagcgatacgctgcgttcagaactggcggcaaattacccgtttatcgaccccgataaaaagatgattctggtgaccggtcacaggcgtgagagcttcggtcgtggctttgaagaaatctgccaggcgctggcagacatcgccaccacgcaccaggacatccagattgtctatccggtgcatctcaacccgaacgtcagagagccggtcaatcgcattctggggcatgtgaaaaatgtcattctgatcgatccccaggagtatttaccgtttgtctggctgatgaaccacgcttggctgattttgaccgactcaggcggcattcaggaagaagcgccttcgctggggaaaccggtgctggtgatgcgcgataccactgagcgtccggaagcggtgacagcggggacggtgcgtctggtcggcacggataagcagcgaattgtcgaggaagtgacgcgtcttttaaaagacgaaaacgaatatcaagctatgagccgcgcccataacccgtatggtgatggtcaggcatgctctcgcattctggaagcgttaaaaaataatcggatatcactatgagttttgcgaccatttctgttatcggactgggttacatcgggctgcctacagcagctgcgtttgcctcaaggcaaaaacaggtgattggtgtcgatatcaaccaacacgcggttgataccatcaatcgtggcgaaatccatatcgtcgagcctgatttggcgagcgtagtaaaaactgccgtagaaggcggttttttacgagcgagcacgacgccagttgaagcggatgcctggttgattgctgtacccacgccgtttaaaggcgatcatgagccagatatgacctacgttgaatcggctgctcgctccatcgcgccagtgctgaaaaaaggcgcgttggtgatccttgaatccacctcgccggtggggtcaaccgagaagatggcagaatggttagcagagatgcgtccagatctcactttcccacagcaggtgggcgagttggcggacgtcaacattgcttactgcccggaacgcgtattaccgggccaggttatggtcgagctgattaaaaacgatcgcgtgattggtggtatgacgccggtttgttcggcccgcgccagcgaactgtacaaaattttcctcgaaggtgagtgtgtcgtcactaactcgcggacggcagaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgtcaatattcttcagccaggccctggcgtgggcggtcactgcatcgctgttgatccgtggtttatcgtggcacagaacccccagcaggcgcggcttatccgtaccgcgcgcgaagtgaacgatcacaaaccgttctgggttatcgatcaggtgaaagcggcggtggctgattgtctggctgctaccgataaacgcgtcagtgaactgaaaatcgcctgctttggtctggcgtttaaaccgaatattgatgacctgcgcgaaagtccggcaatggaaatcgctgaactgatcgcccagtggcacagcggcgaaacgctggttgttgagcctaacatccacgagttgccgaagaaactgaccgggctttgtactctggcgcagcttgacgaggcgctggcaacggcagatgtgctggtgatgctggtcgatcatagtcagttcaaagttatcaatggcgacaacgtccatcagcagtatgtcgtcgatgccaaaggagtctggcgctgatgagaaagattctgataacaggtggtgccgggtttattggctcggcgctggtgcgttatatcatcaacgaaacgagcgacgcggtggtggtggtcgataagctgacctacgccggaaacctgatgtcgctggcaccggtcgcgcaaagcgagcgctttgcctttgagaaagttgatatctgcgatcgggcagaactggcgcgcgtattcactgagtatcagccagactgtgtcatgcatctggcagccgaaagccatgttgaccgttctattgacggcccggcagcgtttattgaaaccaacattgtcgggacttatacactgcttgaagcggcgcgggcttactggactgcgctgacggaagataaaaaatcagcgttccgttttcatcatatctccaccgacgaagtatatggtgacctgcactcgacggatgatttcttcaccgaaaccacgccgtatgcgccgagtagcccttattccgcgtcaaaagccagcagcgaccatctggtgcgcgcctggctgcggacctatggtctgccgacgcttatcaccaactgctcgaataactacggtccttaccactttccggaaaaactgatcccgctgatgatcctcaacgcgctggcgggtaaaccgctgccggtatatggcaacgggcagcaaatccgtgactggctgtatgttgaagatcacgcccgcgcgctgtattgcgcggcgaccaccgggaaagtcggtgaaacctataatattggtggtcacaacgagcgtaagaatctcgatgttgtggaaaccatttgcgagctgctggaagaactggctccgaataagccgcacggcgtggcgcactatcgtgacctgatcacctttgtcgctgaccgtccggggcatgatctgcgttatgccattgatgcttcgaaaattgcccgtgaacttggctggctgccgcaggaaacctttgaaagtggaatgcgtaaaacggtgcagtggtatctggctaatgaaagctggtggaagcaggtgcaggacggcagctatcagggcgagcgtttaggtctgaaaggctaattttcagcggaggcaaacatgaaaggtattatcttggcgggcggttccggcacccgattgcatccgattacgcgcggcgtatcgaagcaactgttgccgatttacgataagccaatgatttactatccgctgtcggtgctgatgctagccggtatccgcgaaattctcatcattactacgccggaagataaaggttatttccagcgcctgctgggtgacggcagtgagttcggtatccagctggaatacgccgaacagcccagtccggacggtctggcgcaggcctttatcatcggtgaaaccttcctcaacggtgaaccttcttgtctggtgctgggcgataacatcttcttcggacagggcttcagtccgaagctgcgtcatgttgcggcgcgcacggaaggggcgacggtatttggctatcaggtgatggacccggaacgctttggcgtggtggagtttgacgacaatttccgcgctatctcgctggaagaaaaaccaaaacagccgaaatcaaactgggcggtgaccgggctttatttctacgacagtaaagtcgtggagtacgcaaagcaggtgaagccgtcggagcgtggtgaactggagattacctccatcaaccagatgtacctcgaggcgggcaacctgaccgttgaactgctcgggcgcggatttgcctggctggataccggcactcacgacagcctgattgaggccagcacttttgtgcagacagtagaaaaacgccagggctttaagattgcctgcctggaagagattgcctggcgtaacggctggctcgatgacgagggtgtgaagcgtgctgccagttcattagcgaaaactggctacggccaatatctgctggagttacttcgtgcccgtccgcgccagtattgagccactaacctgggaaaacgccttctttggtgttaacagcgccatcgtgcgcattacgtctgaagcaccgctcctgacgccagacgcgttagcgccgtggtcacgggtgcaggccaaaattgcggcatcaaatacgggtgaactggatgctctgcaacagctgggattctccctggtagaaggtgaagttgatttggcactacccgtgaacaatgtcagtgatagcggtgcagtagtggcacaagagaccgatattcccgcattacgtcagttagccagcgccgcatttgcgcaaagccgttttcgtgcgccgtggtatgcgcctgacgccagcggtcgcttttatgcacagtggattgaaaatgccgtgcgcggcacctttgatcatcaatgtctgattttacgtgcggcgtccggcgatattcgcggttatgtctctttacgggaactcaatgcgacagatgcgcgaattggcctgctggctggacgcggtgcaggtgctgagctaatgcaaacggcgctaaactgggcgtatgctcgcggtaaaacaactttgcgggtggcgacccagatgggcaacaccgccgcgcttaaacgatacatacaaagtggtgcgaatgtagaaagcaccgcgtactggttatacaggtgatcacatgattccatttaacgcaccgccggtggtgggaaccgaactcgactatatgcagtcggcaatgggtagcggcaaactgtgcggcgatggtggttttacccgtcgctgccagcagtggctggagcaacgttttggcagcgccaaagtgttactgacgccatcctgtaccgcttcgctggagatggcggcgctgctgctcgatatccagcctggcgatgaagtgatcatgccgagctatacctttgtctccaccgccaatgcctttgtgctgcgtggcgcgaaaatcgtctttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaagaagcataatctgtttgtggtggaagatgccgctcagggcgtgatgtccacttacaaagggcgtgcgctgggaaccattggtcatattggctgctttagcttccatgaaaccaaaaactacacggcgggtggtgaaggcggcgcgacgctgattaacgataaagcgttgatcgaacgagccgagatcatccgtgaaaaaggcacaaaccgcagccagttcttccgtggtcaggtcgataaatatacctggcgcgatattggctccagctatttgatgtccgatctgcaagctgcgtacctgtgggcgcaactggaagctgcggatcgtatcaaccagcaacgtctggcgctgtggcaaaactactacgatgcgctggcgcctctggcaaaaaatgggcgtatcgagctgccgtcgattcccgatggctgcgtgcagaacgcgcatatgttctacattaaactgcgggatattgatgaccggagcgcattgattaactttctgaaagaagcggaaatcatggcggtgttccattacattccgctgcacggttgccctgcgggggaacgctttggtgagttccacggtgaagatcgctacaccaccaaagagagcgagcgcctgctgcgcctgccgttgttctacaacctgtcgcccgtcaatcagcgtacggtaattgcgaccttgttgaactacttctcctgatatgtcgttggcaaaagcgtccttgtggacggcggccagtacactggtcaagattggtgccgggttactggtcggtaagttgctggcagtgtcatttggtccggcggggcttgggctggcggcaaatttccgccagttgattaccgtgctcggcgtgcttgccggggcaggcatctttaacggcgtaaccaaatacgttgcccagtatcatgataatccccaacagctgcgccgcgtggtcggcacttcatcagcgatggtacttggcttctctacgctaatggcgctggtttttgtgctggcagctgcgctaatcagccaggggttgtttggtaataccgactatcaggggctggtgcgtttagtggcgctggtgcaaatggggattgcctggggcaacctgttactggcgttgatgaaaggctttcgcgatgccgcaggtaatgcgttatctctgattgtcggtagcttgattggcgttctcgcgtactacgtcagttatcgtttgggcggttatgaaggggcgttgctgggtctggcgctgattcccgcgctggtggtaattcctgctgttatcatgttgatcaaacgtggtgtcatcccgttaagctatctgaaacccagctgggataacggtctggcagggcagttgagcaaatttacgctcatggcgttgattacgtcggtgaccttgcctgttgcttacatcatgatgcgtaaactgctggcggcgcagtatagctgggatgaagtggggatctggcaaggggtgagcagtatttccgatgcctacctgcaatttattacggcatcgttcagcgtatatttgctgcccacgttgtcgcggttaacggaaaagcgcgatatcacccgggaagtggttaaatcgctgaaattcgtcttaccggcagtggcggcggcgagttttaccgtctggttgctgcgtgattttgctatctggctgctgttgtcgaataaatttaccgctatgcgcgatctctttgcctggcagttggtgggtgatgtgttaaaagtgggcgcttatgtctttggttatctggtgatcgccaaagcgtcactgcggttttatattctggcggaaatcagccagttcactttattgatggtatttgcccactggctaatccctgcgcatggcgcactgggcgcagcacaggcctatatggcaacctatatcgtctatttttctctttgttgtggcgtgtttttactctggcgtaggtgggcatgactgtactgattcacgtactgggatcggatatccctcaccataaccgaaccgttctgcggtttttcaacgacgcgctggccgcgacgagcgggcacgcgcgcgagtttatggttgctggcaaggacgacggcttaagtgatagctgtccggcgctttctgtgcaatttttccctgggaaaaaatcgctggcggaagcggtcatcgcgaaagcaaaagctaaccgtcagcagcgattttttttccacggtcagttcaatcccaaactgtggctggctctgctgagtggtggcattaagcccagccagtttttctggcatatctggggagcagacctgtatgagctttccagtggcttgagatataagcttttttacccgctacgtcgcctggcgcaaaagagagtcggctgtgtatttgccacccgcggtgatttgagcttttttgccaaaacgcatccaaaggtgcggggagaactgctgtacttcccgacgcggatggacccttctcttaatacgatggcgaacgatcggcaacgtgaaggaaaaatgaccattctggtggggaactccggtgaccgcagcaatgagcatattgctgccttgcgcgccgttcatcagcaatttggcgatacggtaaaagtggtggtgccgatgggatatccgcctaataacgaagcgtacatcgaggaagttcgtcaggcgggactggagttattcagcgaagaaaacctacaagttctgagcgaaaaactggaatttgacgcctatctgacgctacttcgccagtgcgatctcggttactttatttttgcccgccagcagggcattggtacgctttgcttactgattcaggcgggcattccttgcgtgcttaaccgggaaaatccgttctggcaggatatgacggaacagcatttgccagtactgtttactaccgatgatctcaacgaggatattgtgcgtgaagcgcagcgccagttggcgtcggtggataaaaacaccattgccttctttagccctaactatctacaaggctggcagcgggcgttggcgattgccgccggggaggtcgcatgagtctgctgcaattcagtggcctgtttgttgtctggctgctctgcacgctgtttattgccacgctgacctggtttgagtttcgccgtgtgcgctttaacttcaatgtcttcttttcattgctgtttttgctcacctttttcttcggctttccgctgaccagcgtgctggtatttcgctttgatgttggtgtcgcgccgccagaaatcttgttgcaggcgttgctttctgcaggctgcttctacgcggtttactatgtcacctacaaaacccgtctacgcaaacgcgttgctgatgcaccgcgccgtccgctgtttaccatgaaccgcgtggagaccaatctcacgtgggtgatcctgatgggcatcgctctggtgagcgtcggcatcttcttcatgcacaacggctttttgctgttccggcttaattcttacagtcagatcttttccagcgaagtctccggcgtggcattaaaacgcttcttttactttttcatcccggcgatgctggtggtttattttctgcgccaggatagcaaagcgtggctgtttttcctcgtcagcacggttgcctttggcttgttgacttacatgattgtcggcggcactcgcgccaatatcatcatcgcattcgctatcttcctgtttattggcattattcgcggctggatttcgttgtggatgctggcggcggcgggcgtgctggggattgtgggcatgttctggctggcgctaaaacgctatggaatgaatgtgagcggcgatgaagcgttctatacgtttctctatctcactcgcgacaccttctcgccgtgggagaatctggcgttgctgttgcagaactacgacaacatcgacttccagggcctggctccaattgtccgcgatttctatgtctttatcccttcctggctgtggccgggtcgcccgagtatggtgctgaactccgccaactactttacctgggaagtgctgaataaccactccggactggcgatctcgcctacgcttataggctcactggttgttatgggcggcgcgttgttcatcccgctcggggcgattgtggttggactgattatcaaatggttcgactggctgtatgagctgggcaaccgcgagactaatcgctataaggctgcgatattgcacagtttctgcttcggggcgatcttcaatatgatcgtgctggcgcgtgaagggctggattcgtttgtctcacgcgtggtcttttttatcgtggtcttcggcgcatgtctgatgatcgcaaaactgttgtactggctttttgaaagcgccggactcattcataaacgaacaaaatcatcgctccggacgcaggttgaaggataacaatgaataacaacaccacggcaccgacctatacgctgcgtggcttacagttgattggttggcgtgatatgcagcacgccctcgattatctgttcgctgacgggcagcttaagcagggaacgctggttgccattaatgccgaaaaaatgctgaccattgaagataacgctgaggtcagggagttaattaacgctgccgaatttaaatatgcggatggcataagcgttgtacgttcagtacgtaaaaagtacccgcaggcgcaggtttcccgcgttgctggggccgatctctgggaagagctgatggcgcgcgcaggcaaagaagggacacaggtatttcttgtgggcggtaaacctgaagtgctggcgcaaactgaagctaaactgcgcaaccagtggaatgtgaatatcgttggcagtcaggatggttattttaaacccgagcagcgtcaggcgctgtttgaacgcattcatgccagcggagcgcaaatcgtcaccgttgcgatgggagcgccaaagcaggagatcttcatgcgcgactgccgtctggtgcatccagatgcgctgtatatgggcgttggcgggacctacgatgttttcaccggtcacgtaaaacgcgcaccgaaaatctggcaaacgctggggctggagtggctctaccgcctgctttcgcagccgagccgcattaagcgtcagcttcgtttgctgcgttatttacgctggcattacaccggcaacctctgattttcctctctttgtaaagcgacggagtggtcacttcgtcgcctgtctgcttttttattacacaaagcattcaaatttttaatgctttatttgccatttctcctgaattacgaaaacattcgcaacactcgatgtacccataacgataaacggtaacaccggaaagcatgcaaacacaacacgaggatttatggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttacgcgcatcgttatatgagcccgttctttggttatctcaccgcctggtcttactggtttatgtggatggcggtggggatctcagaaatcaccgccattggcgtttatgtccagttctggttcccggagatggcgcagtggatacccgcattgatcgcggtggcgctggtggcgttggcgaatctggctgcggtgaggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgctggtggctggaaagggttcctgaccgcattgtgtattgtggtggcgtcctaccagggcgtggagctgattggcattactgccggtgaagcgaagaatccgcaggtgacgctgcgcagtgccgtaggcaaggtgctgtggcgaatcctgattttctacgttggcgcgattttcgttatcgttactatcttcccgtggaatgaaataggcagcaacggtagcccgttcgtactgactttcgccaaaatcggcattaccgcagcggcgggcattatcaactttgtggttctgacggctgcgctctctggctgtaacagcggcatgtacagttgcggacgtatgctctacgcactggcgaaaaaccgtcagttaccggcggcaatggcgaaagtttcccgtcacggcgtaccggttgcgggtgtggcagtatctattgctattctgctaattggctcatgcctgaactacatcattcccaatccgcagcgtgtgtttgtttacgtctacagtgccagcgtgcttccggggatggtgccatggtttgtgatattgataagccagctgcgttttcgtcgtgcgcataaagcagcaattgccagccatccgttccgctcaatcctgttcccttgggccaactacgtaacaatggcattcctgatttgcgttttgatcggcatgtactttaatgaagatacgcgtatgtcgctgtttgtcgnnnnncattccattcattaattaattaatgaatgaatgnnnnnctaccagcgacagcttgaggcgatcatccattttgccagcgaaaatggcctgcaaagctggcagcaatgtgatgtgacgatggtgcgtaattttgctgtacgcagtcgccgtaaagggctgggagctgcaagtctggcgttacggctttctgcgctacgtagcttttttgactggctggtcagccagaatgaactcaaagctaacccggcgaaaggtgtttcggcaccgaaagcgccgcgtcatctgccgaaaaacatcgacgtcgatgatatgaatcggctgctggatattgatatcaacgatcccctcgccgtgcgcgatcgggcaatgctggaagtgatgtacggcgcgggtctgcgtctttccgagctggtggggctcgatatcaaacacctcgacctggagtctggcgaagtgtgggtgatgggaaaaggcagcaaagagcgccgcctgccgattggtcgcaacgccgtggcgtggattgagcactggcttgatttgcgcgacctgtttggtagtgaagacgacgcgctttttctgtcgaaactgggcaaacgcatctccgcgcgtaatgtgcagaaacgctttgccgaatggggcataaaacaagggctgaataatcacgttcacccgcataaattacgtcactcattcgctacccatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacatgcagcaatgatcaactttgccaaatggcgcagccggatcgacgtcccgcagcaaacccacgacactttaaaacagctggcgaagaannnnncattccattcattaattaattaatgaatgaatgnnnnnctaccagcgacagcttgaggcgatcatccattttgccagcgaaaatggcctgcaaagctggcagcaatgtgatgtgacgatggtgcgtaattttgctgtacgcagtcgccgtaaagggctgggagctgcaagtctggcgttacggctttctgcgctacgtagcttttttgactggctggtcagccagaatgaactcaaagctaacccggcgaaaggtgtttcggcaccgaaagcgccgcgtcatctgccgaaaaacatcgacgtcgatgatatgaatcggctgctggatattgatatcaacgatcccctcgccgtgcgcgatcgggcaatgctggaagtgatgtacggcgcgggtctgcgtctttccgagctggtggggctcgatatcaaacacctcgacctggagtctggcgaagtgtgggtgatgggaaaaggcagcaaagagcgccgcctgccgattggtcgcaacgccgtggcgtggattgagcactggcttgatttgcgcgacctgtttggtagtgaagacgacgcgctttttctgtcgaaactgggcaaacgcatctccgcgcgtaatgtgcagaaacgctttgccgaatggggcataaaacaagggctgaataatcacgttcacccgcataaattacgtcactcattcgctacccatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacatgcagcaatgatcaactttgccaaatggcgcagccggatcgacgtcccgcagcaaacccacgacactttaaaacagctggcgaagaannnnncattccattcattaattaattaatgaatgaatgnnnnngcccgtagctcagctggatagagcgctgccctccggaggcagaggtctcaggttcgaatcctgtcgggcgcgccatttagtcccggcgcttgagctgcggtggtagtaataccgcgtaacaagatttgtagtggtggctatagctcagttggtagagccctggattgtgattccagttgtcgtgggttcgaatcccattagccaccccattattagaagttgtgacaatgcgaaggtggcggaattggtagacgcgctagcttcaggtgttagtgtccttacggacgtgggggttcaagtcccccccctcgcaccacgactttaaagaattgaactaaaaattcaaaaagcagtatttcggcgagtagcgcagcttggtagcgcaactggtttgggaccagtgggtcggaggttcgaatcctctctcgccgaccaattttgaaccccgcttcggcggggttttttgttttctgtgcatttcgtcactttcccttcgcaataaacgcccgtaataacgtattgcgccacggtatgatttcgcccttaacttattgaaggatgacttcaggcaaggagcgaccatgcagcaacaggttccaacgcgtgcttttcatgtgatggcgaaaccgagcggttctgattgtaatctgaactgtgactactgtttttatctcgaaaaacaatccctttaccacgaaaagccagtcacgcatatggacgatgacacgctggaagcgtatgtccgtcactatatcgctgccagcgaaacccaaaacgaagtggcttttacctggcagggcggcgaaccaacgttactcgggctggatttttaccgccgtgccgtggcgctacaggcgaaatatggtgctggcaggaagataagtaatagcttccagactaacggcgtgctgctcgatgacgaatggtgtgcatttctggcagaaaatcattttcttgtagggttatcgctggatggtccggctgagatccacaatcaatatcgcgtgaccaaaggtggcagaccaacgcataagctggtgatgcgtgctctgacgctcctgcaaaaacatcatgtcgactataacgtgctggtctgcgtcaatcgcaccagtgcgttacaacctttgcaagtctatgattttctgtgtgatgcaggtgttgagttcatccagtttattccggtggtcgagcgcctggctgatgaaacggctgctcatgctggacttaagctacatgctcccggcgatattcagggcgaactgacggaatggtcggtgtgcccgcaagagttcggtgagtttctggtggcgattttcgaccactggattaagcgcgacgtcggcaaggttttcgtaatgaatatcgaatgggcgttcgccaattttgtcggcgcaccgggcgcggtttgccatcatcagccaacctgtgggcgctcggtgattgttgaacacaacggcgatgtttacgcctgcgatcactatgtttatccgcagtatcgactagggaatatgcttcagcagacgattgcagaaatgattgattccccgcaacagcaggcatttggtgaagataaattcaagcagttaccggcacagtgtcgcagttgcaacgtgttaaaagcgtgctggggaggctgcccgaaacaccgctttatgctcgatgccagcggcaaacccgggctgaattatttgtgtgccgggtatcagcgttatttccgccatctaccgccatatcttaaagcaatggctgatttgctggcgcacggtcgtccggccagcgacattatgcaggcgcatttgatggtggtgaataagtagaaatcggcggccgcctgcggttgattgccggatgcggcgtgaacgccttatccggcctacaatcattgcaaattcaataaattgcagcgttctgtaggctggataagatgcgtcagcatcgcatccggcaaaggcagatctcagcgatagcgccggcttagtcagatttaatctgcgcgcgtggtggatattttttcaggatctccatatacgcgtgcatttcggtctgtagcggtacacccatcggaatatggcgcacgccgatagagtcgctttcctgcggatcggtgtacaggttaaacaccgacgatcccgccgtttgcattactgtgccggtgaatccaccctgatatccgctctgggtataagcgtaaggttgctgaatcaggacgtgatacttgaactcatccatacgcacagcagaaagtttaccgttgaggaagtagtgctcggccttacggttagactgaccatttgttcccaggaagaaagatgtctggtccacaccatcgataaaggtggttttcggtactaaattcgctactttcgccccaggatgccccgccagatccagcgccgtagggaagagatccgccagatcgacaatgccgtcagatttacgcggttggatcatgcctttccagtaaacgaaggttggcacacgaacgccgccttcccatgtagaacctttcgcaccgcggaacggcgtgcgaccgtgcggcggaacttcggcttccggaccgttatcagaggtgaacacaatcagcgtgttatcaagctgaccgtttttctccagtgctttatacagattggcgaagatatcgttcatctccaccatgcagtcgccgtaagaggtgcgcgccggagagctacccgcatatttggcgttcgggtagttatcgaagtgacagccgcgagtgccgtaatagaggaagaaaggcttatcactcttcgccatcttgtcgaggaacttaacgccatattccatccagcgttgatccaggtcttccatatatttcggcgtaatgtcggcaatggcttcctgttcaccgccgcgcacggcatgaacgtcatctttgctgaacggcagtttttggatgtattcagaacgagccgggctcagggcgacttccgggttgacatgaacatcacgccattcggtatacatatcggacaccgagttaaagccgcggaaatcatcaaagccaacgttctgcggctgcgactctttgttttcccccatatgccatttcccgatagcctgggtgacgtagccctgatcgtgcagcaactgcggcagcgtggttaacccttgcagaccgcccggttgcccgtacattggcggcatcagaatgccgtggtggatggagtattgtccggtgagaatcgtggcgcgggttggggaagaactcggttgagaatacgccgaagttaaaatcagcccctggctggcaacggcgtcgatatctggtgtagggttacccaccgccacgccgccgccgttaaagccaacgtccatccagcccacatcatccagcaagaaaacaaccacgttcggtttcttaccggtttttttctcaagttccgccagtttctgctgggtttctttgtcttgtgcaggatgctgcatcaccggcatcatgttgtcggcaatagtggtcgccggtttaaccagatactggtttgggtgatcgtatccggcaaagcctttgcgtgcggtggcggttgacggggtatctgctgcgctggctatgagaggaagagctgcggcgacagcaacaacaagaagtttgggtgaaaacgaaaattccatgcaaaatgctccggtttcatgtcgtcaaaatgatgacgtaattaagcattgataattgagatccctctccctgacaggatgattgcataaataatagtgataaaaataaattatttatttatccagaaaatgaattgaaaaatcaggagagcattttcaatcctacctctggcgcaggtgatatgtaaggcggtgatgttatatcgcgttgattattgatgctgtttttagttttaacggcaattaatatatatgttattaattgaatgacttttattattcattatatatatgtgtagaattgtgcgcaggagaaatattcactcaggaagttattactcaggaagcaaagaggattacagaattatctcataacaagtgttaagggatgttatttcccggttctctgtggcataataaacgagtagatgctcattccatctcttatgttcgccttagtgcctcataaactccggaatgacgcagagccgtttacggtgcttatcgtccactgacagatgtcgcttatgcctcatcagacaccatggacacaacgttgagtgaagcacccacttgttgtcatacagacctgttttaacgcctgctccgtaataagagcaggcgtttttttatatatcagaaaggccccggaggtgcttgcctccgggtgagaaagagctactgtggcgggttgttctgcaacgttaacatcaaaccgtcgcgacgcatcgctgcggcttcttccggcttgtgcagtctgtccagcgcgtcggcaagccatgcgtaatcgtaggcgtccggacgttgtttcagcgctgcgcggaaggcgagcgatgcttcctgccattctccgtgtttcatcagcgactgacccagtgtgctccacaacagcgggcgatcgcccacgtttttgatctgttggcgcagcactttttccagctgttccgggttattggttttcagacgcgggatcggcagcagcaggcgatcgtcatactggcgtttcaggccatcgatgataatttgctgggcagtatcatgatcgtcacactcaataagatgttccgccattgccacctgcaaggccacctgatgacgcgttttccggctttggtttttccaccagttacgcaaaccttcactaccgttatcggcacgcgcctgatccatcaggccaatccatgcctgttgttccagcattgcacgatgttcttcatcaccaacatgggctttcgccattgatgggatgatatccagcagcgaactccatgcaccagtgcggatatacgcctgttccgccagacgtaatacttccggatggcgtggcgtaacttccagcagcttatccacgccgtgacgtgctgcatggttttcattacgggccagttgcagacgtacacgggtgatttctaccggaatggtgtcattgccggccagctccgctgcgcgttccagatgttggttggcgcgtgcttcatcaccacgttgttgcgcggcttcggctgccagtagatagttcaccaccggttgttcagcgtgatcggcatttttcgccatcagcttttcaacttgctgataatcgccttccgccagtttcagcagcgcctgttcggtctgcttacgtgcacggcgacgcttacgtccgacaaaccacccacgggtgtgcgcgcctgtgcggaagattcgccgcagtagccactcaatggcaaacagcactaccatcgccagaatcaaaataatcgcgaggcccgtgacgctggtttcaatattgtagttgtcggtctggatcagcacgtaaccctgatggccggcaatcatcgggccaaccacgatccccgcaatcagcaacacaaagagcaataacacttttagcatggttattctccttgcggcgcggctgccggagcatcagcttgcggtgcaggtgcaggtgcaggtgcaggtgcaggtttagcttccgttgtccctgctgccggttgtgccagcaggttacgcacgcgggtctgcatcaatttttccagcatcgcctggctttgcagggtttccggaagatccatcgagatattttgctggcttaactggtccacctcgtcgaggaacgctttggtggtggcatcatcagtatcgtagtaagcacgtacccaggtggagacgttctccagcgcctggcgataagtctcttcctggtgacgcggtacagcttgtgctgcgaccagcaggcgagagcgaatattttcgcgcagatagatatcctgatttggcgctaacagcggtacggcggtgtcatcacgacggcgaatcgtaatgaagttgtccataaagttctgccagcttttttgcagattgatacgccattcgctgatggaactggaaagctcttcaccgtcggaatccatcggcgaaccatcgctgtcattatcggccagacgcagattatctacctgatttgaaagctgattaagcttaaggatgataccgtcataatccacctgcgataccgcagaaaggctggcgatatcatcggtaattgcccggcgaacggtaatcagactcgggtcattcatatccgccaggctggcgtctgcacttttcagcaacgctgcagcggtcgtgacgtcctgatcgctccacagcttccgtccggcgagtttcaccagaaaatcggcctgggccagcagccaggttttagcatcgctgccggaaatggtggcgaccttttgttggacttcatccagctgttttgccagcgtttcttgctgacgattcgcctgctcaagctgtacagcttgttgcttgataatgccttccagctcggctttttggctctcctgggctttttgcagtgccgtaagttggttagccagggcatcgctggtggcagtctgattgacggcctgttgtttaccccagccatacaaaccgacgcccgccgccagagcaatagcgatagccaccgcgctgagaatcaatgcggtattgttcttactctttttttctgttgcgacaggttgtgacgtggtgtccacggcctccctggtctcttcaaccacggcggaggttttttcttgttccgtcattatggcttcctgttatgagagttattgtaatgcccgtaaaagcgcatcgttgtcagcgttatcggcgaccttaatgtcttgccagcccagttcccgggcgagtttcgccaaacgctcactgacgaccaatagtcgacagcgtagtaaccagtgctcacgataccattgtgggatcagcgaccagagttgctgcaacatttcaccgctggtaacaacgaccgtcgtcacctcgcgggattgccagcgcatcgcttcttctgcaccatcgtaatggattgcgcatcgttgataacattcacaaaaagtgacctcagcaccgcgcgccgtcagggaatccccaattagctcacgaccgccattgccacgtaatatcagcgcacgtttgcccgcaatattttgtaattcaggtaattgtagcaagacttcgctgatttcccgatcctgcgggtagagaatcttctgtccgcttacggtatgtagtgccagcgcggtggtgcgtccaatggcgaaataatcaggtagtcggggccatttacgatcttgctgatgcagctgtgattgggcaaaagcaaccgcgtgttgcgagagggcaaacaacagatcgctctctcccagcgctgccagttgatcagcaagttgcggtaattgtcgacccggagaaaactcaatcagcggaaaatgccaggccacctgccccagtgtgcgcagacggctcactaactcttctcctgcgggagacgggcgggtgaccaggatactcatgccggggcgtctccgttatagacttcagcgaggatctcgcgcgcgccgttattcagtagctcttctgccagcgaaatccccatttgttcggcatcttgcggcgcaccgcggcgttcaccgcgaataatctgcgaaccgtccggcgcgccgaccaacgcacgcagccagatttcgccatcaataagctcggcgtagctaccaattggcacctgacatccgccttcgagacgggtattcatggcgcgttcggcggtaacgcgcagtgcagtttcgtggtgattcagcgcggcgagcagctcgcgagtgcgtgcatcatcaaggcggcattcaatgcccaccgcaccttgccctaccgccggaagagaaatctcgggtggcaacgcggcgcgaatgcgggactccagacctaaacgttttagtccggctacggcaagaatgatggcatcatattcgccgttatccagtttgctcagacgagtgccgacgttgccgcgcagggagcggataatcagatccgggcggcgttcagccagttggcactggcgacgtaaactggacgtcccgacgatactgcctgccggtaacgcatccagactgtcataggtgttggatacaaaggcatcgcggggatcttcgcgcttgcaaatggtgaccagccccagaccttgtgggaattcaaccggcacatctttcattgaatgtacggcgatatcggcgcgattttcgaggagcgcgacttccagctctttcacaaataagccttttccgcctactttcgccagcggcgtatcaagaatcacatcgccgcgcgtcaccatcggtaccagttcaacgaccaggcccggatggctcgccatcaacttgtctttgacatagtgtgcctgccagagtgcaagtgggctttggcgtgtggcaattcttaaaacattgtctaacatgcttgttaccgtcattatcatccgtggtccatcctaacatccttgccagagcgatgtcagtgttgtggtgaaacgtagacgcctgcgcaaaccgtaaaatgaggtctggcagtggatcctgacaggcgctttgagccttcgtaataaggaatttacagagaataaacggtgctacacttgtatgtagcgcatctttctttacggtcaatcagcaaggtgttaaattgatcacgttttagaccattttttcgtcgtgaaactaaaaaaaccaggcgcgaaaagtggtaacggttacctttgacatacgaaatatcccgaatgccgcgtgttaccgttgatgttggcggaatcacagtcatgacgggtagcaaatcaggcgatacgtcttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggacccaccgaaaggtgagcttccaattactggtgtatacaccatgggcagcacctcgtccgtagggcaaagttgttcctctgacctggatatctgggtctgtcatcaatcctggctcgatagcgaagagcgccagttgctacaacgtaaatgtagtctgctggaaagctgggccgcctcgctgggtgtggaagtcagcttcttcctgattgatgaaaaccgcttccgtcataatgaaagcggcagcctggggggcgaagattgtggctccacccagcatatactgctgcttgacgaattttatcgtaccgccgtgcgtctcgccggtaagcgtattctgtggaatatggtgccgtgcgacgaagaagagcattacgacgactatgtgatgacgctttacgcgcagggcgtgttgacgccaaatgaatggctggatcttggtggcttaagctcgctttctgctgaagagtactttggtgccagcctttggcagctctacaagagtatcgattccccatacaaagcggtgctgaaaacactgctgctggaagcctattcctgggaatacccgaacccacgtctgctggcgaaagatatcaaacagcgtttgcacgacggcgaaatagtgtcgtttggtctcgacccgtattgcatgatgctggagcgcgtcactgaatatctgacggcgatcgaagattttactcgtctggatttagttcgccgatgcttctatttaaaagtttgcgaaaaactcagccgtgaacgcgcctgcgtaggctggcgtcgtgaagtgttaagccagttggtgaaagagtgggaatgggacgatgctcgtctggcgatgcttgataatcgcgctaactggaagattgatcaggtgcgtgaggcgcacaacgagttgctcgacgcgatgatgcagagctaccgcaatctgatccgctttgcgcgtcgcaataaccttagcgtttccgccagcccgcaggatatcggtgttctgacacgtaaactgtacgccgcgtttgaagcgttaccgggtaaagtgacgctggtaaacccgcagatttcacccgatctctcggaaccgaatctgacctttatttatgtgccgccgggccgggctaaccgttcaggttggtatctgtataaccgcgcgccaaatattgagtcgatcatcagccatcagccgctggaatataaccgttacctgaataaactggtggcgtgggcatggtttaacggcctgctgacctcgcgcacccgcttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagctgcgttccgcaatcaggtggtgcattttgatttccgtaagctggatgtcttcagctttggcgagaatcaaaattgcctggtaggtagcgttgacctgctgtatcgcaactcgtggaacgaagtgcgtacgctgcacttcaacggcgagcaatcgatgatcgaagccctgaaaactattctcggcaaaatgcatcaggacgccgcgccgccagatagcgtggaagtcttctgttatagccagcatctgcgcggcttaatccgtactcgcgtgcagcaactggtttctgagtgtattgaactgcgtctttccagcacccgccaggaaaccgggcgcttcaaggcgctgcgcgtctccggtcaaacctggggcttgttcttcgaacggctgaatgtctcggtacagaaactggaaaacgccatcgagttttatggcgctatttcgcataacaaactgcacggcctgtcagtgcaggttgaaaccaatcacgtcaaattaccggcggtggtggacggctttgccagcgaagggatcatccagtttttcttcgaagaaacgcaagacgagaatggctttaatatctacattctcgacgaaagcaaccgggttgaggtgtatcaccactgcgaaggcagcaaagaggaactggtgcgtgacgtcagtcgcttctactcgtcttcgcacgaccgtttcacctacggctcaagcttcatcaacttcaacctgccgcagttctatcagattgtgaaggttgatggtcgtgaacaggtgattccgtttcgcaccaaatctatcggtaacatgccacctgccaatcaggagcatgacgcgccgctgttgcagcagtatttttcgtgatgaaagtgccggaaagcgaggcttatccggcatgcaatcttagcggaaactaactgtttcacccgcctgctgcgtcgccgcctgttccagcaaatcccagaaggtttcaccgctacgatcgcaaatccactcgtcgcctttcagatcaaaatggtagccaccctgtttggttgccagccacacctggtgcagtggttcctggcggttgataatgattttgctgccgttctcaaaggtaatggttagtacaccgccgttgatttcacagtcgatatcgctgtcgccatcccagtcgtccagatgttcttcaatggtcagccacagttgatcagccaggcgatgaaattcactgtcgttcattgttgtatcctgtttttaagtgatggcggcagtatagcggcatggggtcagggcttcaaagtttgcccgtctgctgctgcgttccggcatgattcatccgtcaccggaataataatgtcgctgttatgaatttcacggacattctcttctctgacgcgtgttttcgccgggcagtgggagggcgtaatccttacctctgtatcagtccaggtataaacattgcgatcgtcataagcgaagcgatcgtttttagttagcggaccgttaactggaataatttgcacgctcttgcgtgaccgtaattggcggataaagtaagcatgttgtttgccgctattaaatgagtcatcaatgaccaggtctggcgtatccagcgggattatctcaagctggtcttcaccaaaagtcgataattttgttacatacagtcgatctttatactgcgcaatattgtcagtaatcagatgaaattgttcaggttcaatacccggtaggtctatccacttgctccactgacggtcgggcgtgagctgtttacgccagcgaacgcgactttcccctacttcaaaagagacgtcatcatctacgggtatcgctttgccagataattgaccaaagggataacgatgcagacccttattgtcgcgaaaaaccagcagtgaatgaggtatccagcgaattatctcaaatgagtctgcattcgccgtaaggtgagcgccatttaaataaatattctgcccactgcggataagcagatcattggaatacaaatttctgtttacactcataagacgtggattaataccccaccatcttttttctaatacagtaacattactgctgctcccctgacgtcgaccggacaagtagagatttttactatccaccagcgtggtagagttaccttcgatagcttttagtgtcgccagatcaacacgtgacgcgccgctattactttcggtacgctgtccgtcaaaatagaggctatatttatcgaccgcgaagcggcccatagcctgaaagctggcaatatcgacagtgggtgttcccggtggattgctaacgattttgccacgccagagaataacgtggccgtctgtcacccagtgatattcctcattttctatgcttatttcatcggaaggtatataacccgtcttcccagagatatttttcacaaggcgcaaatcggccctgttcatctccggaaattgggcaatgattttcttatccccccaataacctttaccgtaagacatgacactgtgatcattgtaatagtcgaaccctatggcctgtacaggaggtgtcagaaatgtgttccccaacaggatgagtgcaactgtgattatttgaccattcattttgttgcctcattgcgtggggcaggaataaattcgccgtcatcggtaatttttccgtccagatatcccgttttgtaatttacgccatagccatatcccgaatgttgttccttccagattaagcgaacttgtttcggatcagcggtgcggtatcgccagagctgcgcgccatcaaagctgtaaacgtagcggttatcgcgggcataccatctgcgcaaaaagggatggtcattaagatgggcttcgcgttcatccggagagcggttatccagtaagatcagcggtccgtcagattcaaacacgtgtaaactggaatggtttacccacccttcggcacgcgtaagtaaatagccgtggcgtttcccggcgttgaaacgtttgttgataataagattggggtcatcgagttttacgatctccaacttgcggtcaccagactctgtttcgatgatggtataaagcgaatcctgatactgggcgacagcatcactgatggggtggaactgttcaggatcgagtccggataattcttcctgtttacaagcaggccctttacgccagaacactttcttttcctgcagagaaaaatccagacagtgctttgttaaatcttcatcccacgccagattttccttgtcgaggactttacgctgcagcccgtttttatcacgccaggtgaagagtgagccgggcatccagcgcacgacggaaaaggtgtccgggtcggcatccagttgttctccgttgatcatgattttcgtctgtgtgcgggctagcgtatcccaggggccaaatggggcaggaaggcagggattaaatgctgtagagaatttaccgcgctgatcccatgacttttgagccagtaccgtaaaggtgtcgggatcatcaaggcgctgaccatttgcgtaaagatagtgcttgtcacggagaatcaaacctagccagtctggtttccattgcgggttaaattctacctgacgcaacgttcggcggtttagttgctggttgctatcggtgcgtttgccttcgtaatagaggctgtacttatctgcggcaaaatcaccccatgcctgaaatgacgagatatcgactggcggtgtgcctggagggttttgcacaatctcgccagcgtagagaatagcgcgaccatcgctatagtaagagtaatggggaagagttgcgtttgcgccgctgtagacaacgtctgtcatgagattggtagccgggggcaccgtttcccaatcctccagtttggttgggtcaattagcaaattcggtaacagacgcagacgcttgtagttaatctgcggtagcgaaagattggtcttttcataagggcgcaaatacaccacgccttttccctgtttctggtaaatattatgttccggctcatcaagccgacatccccatgccgacgataaaaacaacgaacaagacaataaacaaaccacattgcgatagtgcataaagccatcctggcgcgaggtgccgatcacgaaactaccagcaaaacataaatccccacgtgtaagcgttatactcgcagcatttcctcacttttcagacttcataaagagtcgctaaacgcttgcttttacgccttctcctgcgatgatagaaagcagaaagcgatgaactttacaggcaatccataatgaaaaacgtgtttaaggcactcactgtattacttactctcttcagcctgacgggctgcggtctgaaaggtccgctctatttcccgcctgcagataaaaacgcaccgccgccgaccaaaccggtagagacgcaaacgcaatccacggtgccggacaaaaacgaccgcgccactggcgatggtccatcccaggtgaattactaaaagtcagtttctgtacccgcgtgattggagtaaatgatgcagttctcgaaaatgcatggccttggcaacgattttatggtcgtcgacgcggtaacgcagaatgtctttttttcaccggagctgattcgtcgcctggcggatcggcacctgggggtagggtttgaccaattgctggtggttgagccgccgtatgatcctgaactggattttcactatcgcattttcaatgctgatggcagtgaagtggcgcagtgcggcaacggcgcgcgctgctttgcccgttttgtgcgcctgaaagggctgaccaataagcgcgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccacattgcgtgattcaggtcgatgatgtcgataccgctgcggtagaaacgcttggtcctgttctggaaagccacgaacgtttcccggagcgcgccaatatcggttttatgcaagtggttaagcgcgagcatattcgtttacgcgtttatgagcgtggggcaggagaaacccaggcctgcggcagcggcgcgtgtgcggcggttgcagtagggatccagcaaggtttgctggccgaagaagtacgcgtggagctccccggcggtcgtcttgatatcgcctggaaaggtccgggtcacccgttatatatgactggcccggcggtacatgtctacgacggatttattcatctatgaagcaaccaggggaagaactgcaggaaacactcacggagcttgatgaccgggcggttgtcgattatctgattaaaaatcctgagttttttatccgcaatgcgcgcgcagtagaagcgatacgtgtgccgcatccggtacgcggcaccgtttcgttggtcgagtggcacatggcccgcgcacgtaatcatattcatgttctggaagagaacatggcgctgttgatggaacaggcaatcgccaacgaaggcctgttttatcgtctactctacctgcagcgcagtctcaccgccgccagcagtctcgatgatatgctgatgcgctttcaccgctgggcgcgcgatctcggcctggcaggtgcgagtctgcgcctgtttccggatcgctggcgcttaggtgcgccgtcgaaccacactcatctggcattaagccgtcagtctttcgaaccgctgcgtattcagcgtctggggcaggaacagcactatctggggccgcttaacggaccggagcttctggtggtgctaccggaagcgaaagcggtgggatcggtggcgatgtcgatgctgggaagcgatgctgatttgggtgttgtgctgtttaccagtcgcgatgccagtcactatcaacaagggcagggaacgcagttacttcatgaaattgcactgatgttgccggagcttctggcgcgttggattgaacgcgtatgaccgatttacacaccgatgtagaacgctacctacgttatctgagcgtggagcgccagcttagcccgataaccctgcttaactaccagcgacagcttgaggcgatcatccattttgccagcgaaaatggcctgcaaagctggcagcaatgtgatgtgacgatggtgcgtaattttgctgtacgcagtcgccgtaaagggctgggagctgcaagtctggcgttacggctttctgcgctacgtagcttttttgactggctggtcagccagaatgaactcaaagctaacccggcgaaaggtgtttcggcaccgaaagcgccgcgtcatctgccgaaaaacatcgacgtcgatgatatgaatcggctgctggatattgatatcaacgatcccctcgccgtgcgcgatcgggcaatgctggaagtgatgtacggcgcgggtctgcgtctttccgagctggtggggctcgatatcaaacacctcgacctggagtctggcgaagtgtgggtgatgggaaaaggcagcaaagagcgccgcctgccgattggtcgcaacgccgtggcgtggattgagcactggcttgatttgcgcgacctgtttggtagtgaagacgacgcgctttttctgtcgaaactgggcaaacgcatctccgcgcgtaatgtgcagaaacgctttgccgaatggggcataaaacaagggctgaataatcacgttcacccgcataaattacgtcactcattcgctacccatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacatgcagcaatgatcaactttgccaaatggcgcagccggatcgacgtcccgcagcaaacccacgacactttaaaacagctggcgaagaaatggccgctggtggcgatcaccaacggtaacgcccagccggaactgtttggtttggggcattattttgagtttgtgctgcgcgctggcccgcacgggcgctcaaaaccgttcagcgatatgtacttcctggcggcggaaaaactcaacgtgccgatcggcgagatcttacatgtcggggacgatctcaccactgacgtgggtggggcaattcgcagcggaatgcaggcctgttggatcagaccggaaaatggcgatctgatgcaaacctgggacagccgtttactgccgcatctggaaatttcccggttggcatctctgacctcgctgatataatcagcaaatctgtatatatacccagctttttggcggagggcgttgcgcttctccgcccaacctatttttacgcggcggtgccaatggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggctgatgagcgtggaaaactgctcgccatactcgattatggcggtaacgtttaccaacaaagcggcggcggagatgcgtcatcgtatcgggcagctgatgggcaccagccagggcggcatgtgggtcggcaccttccacgggctggcgcaccgtctgctgcgtgcgcaccatatggacgccaatctgccgcaggattttcagatcctcgacagcgaggaccagctacgcctgctcaaacgcctaatcaaggcgatgaacctcgacgagaagcagtggccgccgcgccaggcaatgtggtacatcaacagccagaaagatgaggggctgcgtccgcatcatattcagagctacggtaatccggtggagcagacctggcagaaggtgtatcaggcgtatcaggaagcgtgtgaccgcgcgggcctggtggacttcgccgagctgctgctacgtgctcacgagttgtggcttaacaagccgcatatccttcagcactatcgcgaacggtttaccaatatcctggtggacgaattccaggataccaacaacattcagtatgcgtggatccgactgctggcaggcgatactggcaaagtgatgatcgttggcgatgacgaccagtcaatctacggctggcgcggagcgcaggtggagaatattcagcgtttcctcaatgatttccccggtgctgaaactatccgtctggagcagaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgacgaagcgcgttttgtggttaaccgcatcaaaacctggcaggacaacggcggggcgcttgccgagtgcgccattctctaccgcagcaacgcccagtcgcgtgtgctggaagaggcgttattgcaggcgagtatgccgtatcgtatttacggcgggatgcgcttcttcgaacgccaggaaatcaaagatgcgctctcgtatctgcgcctgattgccaaccgcaacgacgacgcggcctttgagcgtgtggttaatacgccaacgcggggtattggtgaccggacgctggacgtggtacgtcagacatcgcgcgatcgccagttaacactctggcaggcatgtcgtgaactgttgcaggaaaaagccctcgccggacgtgctgccagcgccttacagcggtttatggagctgatcgacgccttagcgcaggaaactgccgatatgccgctgcatgtacagactgaccgggtaattaaagactccggcctgcgcaccatgtacgagcaggagaagggcgaaaaaggtcagacgcgtatcgaaaacttagaggaactggtgacggcaacgcgccagttcagctacaacgaagaagacgaagatttaatgccgctgcaggcattcctctcccatgcggcgctggaagcgggcgaggggcaggcggatacctggcaggacgcggtgcagttgatgacgctacactcggcgaaaggtctggaattcccgcaggtgtttatcgttggtatggaagagggcatgttcccaagccagatgtcgctggatgaaggcgggcgtctggaagaagaacgccgtctggcctacgttggcgtaacccgcgcgatgcagaaactgacgctgacctacgcggaaacccgccgtctatatggcaaagaggtttaccatcgcccgtcgcgctttatcggtgagttgccggaagagtgtgtggaagaggtgcgcctgcgcgccacggtaagccgcccggtcagccatcaacggatggggacgccgatggtcgagaacgacagcggctacaagctcggccagcgcgtacgccacgctaagtttggtgaaggcaccatcgtcaatatggaaggcagcggtgagcatagccgtttgcaggtggcgttccagggccagggtattaaatggctggtggcggcttacgcccggttggagacggtgtgacgttgcggaatgcggtgcgccataccgcattccgcatcagcaccttacttagcgcacttcttcacatcaatattccagtcagcaccagacgcaacctgatgtttctgcgcgaaattatccatattcagcgccacggaaacattcaataagctgttcagatacaccatcggctggccttccggcacatcgccgaagcttgcgacatacggcattttccctgcgtatttttgctgggaaccttcggaaatggtcacacacaacgtgtcgttgagtttgattcctgcctgattcagcaactcgtcgctgatattgctccagacgttgccgtactgaatatcgagaatcgggatattgcccttcacttcaccttttgttgctttggctttctgataagaaagttcgacaacttttgcaggaagctctggccccacctgctcgaacgtgatcgccccggaagccagacgtgcaccggtgtaggcatacacgtcacgaccgtggaaggtatatgacttttcggaacctttcagacggttggttttttcatcgatttgccggacgctctcaatacccagcgattccgccaccaacgtgagcgtaccgttatctggtgaaacgaagtactgaccatttttggttttcagcactaccgatttacggtctgtaccaacacctggatcgaccacgctaacaaacaccgaaccttgcggccagtaactggcagtctgatacaggcggtaagcgccttcccagatgttatacggtggaatttcgtgtgttaaatcaaatattttaagattatggtcaacgccgaaagcgacccctttcatcgccgagacggcgccatctttcaggctaaaatccgtttgtaaaatcaaagcgttatccgcataagcggatgatgaccccagacaggttaataaaaataatgttgcgagcgtttttttcatttttgtttcccttcatttatctgatgattttccagctgtgtagccagccccagtttgtctggcctcctcgagtgtacaatgtttaacctttctgctcgacggaaatcatggtgacaaaaggatagcgttgccacgggattgcctcgcctttcatatacatatgtgaaattgtgccatcaagataaagcagctgctcaacgttcagtttcgctttggcataacaggcaaaatcataaaaatttgtcgcctgctggctcaacaaaaacacggcgttcccatgtttattaatcccaacaccgttacgaattttacgtgaggcgacgttgggatgaatacgcggattaattacaccgttttccatcaacaatggccctgactgcaccgcaaactgaatctctttactggttttaaaggcatccagacgaacgatgccgactttatctcccgcgacataaaacactccgccaggacgaataaagaaattcccttcacctgaagcgagatttaacgccaccttctgctgaccgttttcgatgtacaaaccgagcggcgcatagctttcatcatagatgccgccgttcatcgccatctgcacctgaccctgactattaatatccgccagcagagcatgtaacgttccccacgcttcgccattggctttttgccagtacattttcacccgctctgtttgaggattaacggtatacgcctgtacggtcagcgtcggatctgagggtgcgcaatcatcagcggcaacagcaaacaagggaagtaaggtgagggtgagaaaaatccgtttgagattcaaggtgatcattcctttaccaatgaatagccgatgcgccattataggccctgaatgtgggatttttttatcctgttagcgaccttgacgagtaccaaaaagcgcgaagttcaactattgttctgtggtgttctgttgcgtgttgacggcaaaattttgctggcgtaacatgcgcgcacgatcactctaagaggacattcgccttggacacacccagtagatactggctcattatcctgtcatccaggatcaactcctaaggctatccctttttgctgatagccttagcggttgtcagcgacctcaatttttcccgtcgcgctgagtcaggctgtttaatggtctgaaacccaatttgtttctgtgtgcccaccgaactgtccgatattttaagcattgggagtcccggtcatgctgagcgcatttcaactggaaaataaccgactgacccggctggaagtcgaagagtcacaaccccttgtaaatgcagtatggattgatcttgtcgaaccggacgacgacgagcgactgcgcgtacaatctgaacttggccagagcctggcaacccgcccggaactggaagacatcgaagcatcggcacgtttctttgaagacgatgacggcctgcatattcactccttcttcttctttgaagatgcggaagatcacgccggtaactccactgtggcatttaccatccgtgatggtcgtctgtttactctgcgtgagcgtgaactgcccgcttttcgtctgtatcgtatgcgtgcccgtagccagtcaatggtggacggtaacgcctacgagctgctgctggatctgttcgaaaccaaaatcgaacagttggcagatgaaattgaaaatatctacagcgacctggagcagttgagccgggtaattatggaagggcatcagggcgatgagtacgacgaggcgctctccacgctggcggaactggaagatatcggctggaaagttcgcctgtgtctgatggatacccagcgcgcgctcaacttcctggtacgtaaagcacgcttaccgggtgggcaactggagcaggcgcgtgaaatcctgcgagatatcgaatccctgctgccgcataacgaatccctgttccagaaggtgaacttcctgatgcaggcggcgatgggctttatcaatatcgagcagaaccgcatcatcaaaatcttctcggtggtatccgtggtgttcctgccaccgacgctggtcgcttccagctacgggatgaactttgagtttatgccggaactgaagtggagcttcggctacccaggcgcgattatctttatgatcctcgcgggcctggcaccgtatctgtactttaagcggaagaactggttgtaatataaatgccgggtaaagattgttctttatccggcttattgctgaaaattgtctttttcaaagtcatgcgggttgaacactcgctctatcttattttcctgggttagttgatactcattgttatcagcaataaaaaaatgagtattacggtaaggatattcattaataaccattaaatagttttttacgatgcaattatcattgctcttaatcgtcgggaaacagtagagatcttcatacggcccttcgatatattttttatagtcagtgaagccattaccgatatcaataacataccaggtatgccaactatcttctggtaggggattttgacttttaatttcatcctgatgcttcagataccaatttattttatcgctatcagtccatggcagatgatcaacgaccagaaagactgaattgccagcatcagagtatgtatacaaaatctgtacaggacgcaatgtccataaattatagatgcagcatagaagaaataaatataatataattttctggagttttcttttcatagataattttcgattctttcgatagtgttaaaattggtgaaaaaaggtttgaaagcaaagtctttatgccgttgtaaaaagaaccatatgcgaaaaaatctatacttgttgtaaatcttgttttttatatcagtcacatccaaaccaaagtggtcttgtgctatgaaatgaatggtagcgctccagcccataggatatttttgaaaatttaaaagagatattttttgagctgagatatcatgaatgctgattcccaggccattaaaattatctttaaaatcattgaatttatttagtcttgatgaaagtaattcggtcttaatcttttgtaggagaagaggccggtatcctatcgtaggtgttgaagaaatatcattttcgatacattctttgattacacgtattgggctattataatcatatttgtttattcgttcatgaaaagataagttcaattcctggctatggaaactgttgccattttcatatctaaaatgatcaatcagatcctggatgagtgttttgtattgtccaaaaaaggaaaacatttttgccagatctttcatttctgcaaataaaatatcaatacattcactttgtgatatttttgttccagaagttggaacactaaaagcaccataagtagaattcggcccaggaaaatggtatttaatgaggcggtaaggatcaacttttgcagagatgtcgcttaagccgagagagagaaaatcttgttcttccatatccccatactgcatatcatcagcagaaaaatcatcgaataaagtaatagtttcgaaaagtgtacagggcatattaattgatgagcctaatatgttgttcatttatattctcctttcttataattaagggcaatgttaatttgataagaaataatagggtaaaaaaattttaaaaaagaaatgcacttcacattttttattacattctgaagataacttggttaatgattggtcttgctcatcgctaataacataatgctgaatttaccaaaaatgaaatttattaaagcaaatgaaaatatacaacgacgtctggaaattctgcctttccttatgtgagtctcctgtcagcatggcaatatgcccactctcatgcaagagtcggcatattttttcagaatatatttattttttatttggacgttctacgctgcgtataaatcgcatccatcacaaaaattgccagcgccacccaaataaaggtgaaagttaccatcttatcggcacccggtttttcaccataaaacgtcacagccagcaggaacatcagcgtcggaccaatgtactggaaaaagcctaacgttgagagacgcaggcgtgtcgccgctgcagtaaaacacaacagtggcacggtggtgacaataccggcggcgatcagcagtaaattcagcgacatcgggttttgccccatatgactggttgagctgtcggcaatagcaaacaggtaaatcgccgccacgggcagcaaccacatagtttcgattaacatgccggtttgcgcttcaacagcaatcttcttgcgcaccaggccgtagaaagcaaaactaaacgccagccccagcgcgatgatcggcagtgaaccaaaagtccacaactgaaccagcactccacatatcgccagaatcaccgccagccattgcatccggcggaatcgctcgccgaggaaaatcatccccagcacaatgttcaccagcgggttaataaagtaaccaaggctcgcttccagcatatggtgattgttcaccgcccagataaacagtagccagttgccgccaatcagcacggcagagactgccagcataaaaattttctgtggcgtctgaatcagcgtttttaaataggaccactggcggcaaatgctcatcagcaccaccataaagaaaaacgaccagatcacgcgatgcgtcaggatctcatcggcgggcacgtagtaaatcagtttgaagtacgctggcgcaataccccaaataaaataagcggcaagagcgagtaatacgccctgccgcgtttgttttgcatccatcgggaatactcatttttaattggtaacagcagtttacctgcttttatgtcttcaacctaccatataggtggcggtggcactggcaatataaagctgttcttcattgtgtaattcaacgcgggcgacggcgactttattgcctgcacgtaacaggctactggtagcagtaaaacgctcgcctctgcctgggcgcagataatcgacgcgaagatcaatggtccccatccgcgatagccgctggcgtagttcatcttcactgatggtttcgtggcgggttaaggtacttcccacgcacaccagacctgcggcgacatccagcgccgacgcaatgaccccgccgtgtaaaatgctttgcgcccagttgcccaccatcatcggctgatttttaaaggccagctgtgcgaactctttttcgtaacgctccagttccatccccaatgcgcggttaaatggtatgtgataaacaaacatctcacccactaatttgagggcttgttcagcggtcagtacggcagacataacatccttacacttcattggttaatgaaatgttgattttatgcttctttgttgttggtttctactttaggaagggataactaacggctatggagttaagtatgtaaaatagcccgcagaaaaatattcaccttatcaataattcgttacggagaacacgagcgatgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcaccctttatccttatgacaccaactacatcatctacacccaaaccagcgatctgaataaagaagcgattgccagttacgactgggcggaaaacgcgcgtaaggatgaagtaaagttccagttgagcctggcgtttccgctgtggcgtgggattttggggccaaactctgtactgggcgcctcctacacacagaaatcctggtggcagctttctaatagcgatgagtcatcaccgtttcgtgaaactaactacgaaccgcaattgttcctcggttttgccacggattacaactttgctggctggacgctgcgcgatgtggaaatgggctacaaccacgactcaaacgggcgttcagacccgacttcccgcagctggaaccgcctttatacccgcctgatggcagaaaacggtaactggctggtagaggtgaagccgtggtatgtggtggggaatacggacgataacccggacatcaccaaatatatgggttactaccagcttaaaatcggctatcacctcggtgatgcggtactgagcgcgaaagggcagtacaactggaacaccggttacggcggcgcggagttaggcttaagctacccgatcaccaaacatgtgcgcctttatactcaggtttacagcggttacggcgaatcgctcatcgactataacttcaaccagacccgcgttggtgtgggagttatgctaaacgacctgttttgatgaatggttggcaaatctggaatccagcatccaggattaccctctcagagactaaaagcattgcagtttctcgcgcaggcgctgaaaatagcgcctgtttttatttcaggcaatcggggtgaatgtggcgcaggcggaagtgttgaatctggagtccggagctaaacaggttttacaagaaacctttggctaccaacagtttcgccccggccaggaagagattatcgacaccgtactttccggtcgcgattgcctggtcgtcatgcccactggtggcggaaaatccctttgctatcaaatccctgccttattgctaaacggccttaccgtggttgtttcaccgctgatttccttgatgaaagatcaggtggatcaactgcaagccaacggcgtggcggcggcgtgccttaactcgacgcaaacccgcgagcagcaacttgaagttatgacaggctgtcgcaccgggcaaatccgcctgctttatatcgcgccggaacgcctgatgctggataactttcttgagcatctggcgcactggaatccggtgttattagccgttgatgaagcgcactgtatctcccaatggggccacgatttccgcccggaatacgctgccctcggtcagctgcgtcagcgttttccgacgctgccgtttatggcgctgactgccaccgccgacgacaccacgcgccaggatatcgtgcgcctgctggggctgaacgatccgctaattcaaatcagcagttttgaccgtccgaatattcgctacatgctgatggagaaattcaaaccgctcgatcagttgatgcgttatgtacaggaacaacgcggtaagtcggggattatttactgtaatagtcgtgcgaaagtagaagacaccgctgcgcgcctgcaaagcaagggaattagcgcggcggcctatcatgccgggctggaaaataatgttcgcgctgatgtgcaggaaaaattccagcgcgatgacctgcaaattgtggtggcgacggtggcgttcggcatgggcatcaacaagcctaacgttcgcttcgtggtgcattttgatattccgcgcaatatcgaatcctattatcaggaaactggacgcgccgggcgtgatggcctgcccgcggaagcgatgctgttttacgatccggctgatatggcgtggctgcgccgttgtctggaagagaagccgcaggggcagttgcaggatatcgaacgtcataaactcaatgcgatgggcgcgtttgccgaagcgcaaacttgtcgtcgtttggtattgctgaactattttggcgaagggcgtcaggagccgtgcgggaactgcgatatctgcctcgatccgccgaaacagtacgacggttcaaccgatgctcagattgccctttccaccattggtcgtgtgaatcagcggtttgggatgggttatgtggtggaagtgattcgcggtgctaataaccagcgtatccgcgactatggtcatgacaaactgaaagtctatggcatgggccgtgataaaagccatgaacattgggtgagcgtgatccgccagctgattcacctcggcctggtgacgcaaaatattgcccagcattctgccctacaactgacagaggctgcgcgtccggtgctgcgcggcgaatcctctttgcaacttgccgtgccgcgtatcgtggcgctcaaaccgaaagcgatgcagaaatcgttcggcggcaactatgatcgcaaactgttcgccaaattacgcaaactgcgtaaatcgattgccgatgaaagcaatgtcccgccgtacgtggtgtttaacgacgcaaccttgattgagatggcggagcagatgccgatcaccgccagcgaaatgctcagcgttaacggcgttggtatgcgcaagctggaacgctttggcaaaccgtttatggcgctgattcgtgcgcatgtcgatggtgacgacgaagagtagtcagcagcataaaaaagtgccaggatgaagactccgtaaacgtttcccccgcgagtctaatgtatgttgatgttattcctcaccgtcgccatggtgcacattgtggcgcttatgagccccggtcccgatttcttttttgtctctcagaccgctgttagtcgttcccgtaaagaagcgatgatgggcgtgctgggcattacctgcggcgtaatggtttgggctgggattgcgttgcttggcctacatttgattatcgaaaaaatggcctggctgcatacgctgattatggtgggcggtggcctgtatctctgctggatgggttaccagatgctacgtggtgcactgaaaaaagaggttgtttctgcccctgcgccacaagtcgaactggcgaaaagcgggcgcagttttcttaagggcttactgaccaatctcgcgaaccctaaagcgattatctactttggttcggtgttctcgctgtttgtcggtgataatgtcggcaccaccgaacgctggggcattttcgcgttgattattgtcgaaacactggcgtggtttaccgtcgttgccagcctgtttgctctgccgcaaatgcgccgtggttatcaacgtctggcgaagtggattgatggttttgccggggcgttatttgccggatttggcattcatttgattatttcgcgttaatgccagatgcgtcatcagagtaagtcggataaggcgtttacgccgcatccgacattattttcacgcatgcctcgccgatgctaacagcgctcccaccagcataaataacgagccgaaaatcttattcagcgccttcatctgctttggtcctttaatccatagagcaatccgttgagcaagggtggcgtaaccgatcatcacaataatatcgaccacaatagtggtgacgccgagcacgatatactgcatcagttgtggctgctgcggcatgatgaattgcggaaatagcgccgccagaaacacaatacttttgggattggtgagattcacaaaaactgcgcgctggaacaaatgtcgacgcgattgagtggaggccagcgatttaagatcaattgcgccagcggcgcgccattgctgtattcccagccaaatcaagtaagctgcgcctgcccacttcaacacttcaaacgcaatcactgagcgggaaaatagcgtccccaaccccacgccaaccagcacaatatgaatcgccagtccggtctgaagcccagcaatagacgccaccgcgccgcgataaccgtggttgagcgaggtggtcatggtgttgattgcgccagagcctggcgacaggcttaaaatgatcgatgtcagcaggtaggcaaaccaccattctaaggtcatgatgaactcccggtgtgtctatttttgtgccacaatacgctactgtcgcagcgttgtgtcaggcacgcttaaaaaaacgattttacgtggtttaagaggcagattacccgatgtttcagcagcaaaaagactgggaaacaagagaaaacgcgtttgctgcttttaccatgggaccgctgactgatttctggcgtcagcgtgatgaagcagagtttactggtgtggatgacattccggttcgctttgtccgttttcgcgcacagcaccatgaccgggtggtagtcatctgtccggggcgtattgagagctacgtaaaatatgcggaactggcctacgacctgttccatttggggtttgatgttttaatcatcgaccatcgcgggcagggacgttccggtcgcctgttaggcgatccacatctcgggcatgttaatcgctttaatgattatgttgatgatctggcggcattctggcaacaggaggttcagcccggtccgtggcgtaaacgctatatactggcacattcgatgggcggtgcgatctccacattatttctgcaacgccatccaggtgtatgtgacgccattgcgctaactgcgccaatgtttgggattgtgattcgtatgccgtcatttatggcacggcagatcctcaattgggccgaagcgcatccacgtttccgtgatggctatgcgataggcaccgggcgctggcgcgcgttgccgtttgctatcaacgtactgacccacagcagacagcgatatcgacgtaacttacgtttctatgctgatgacccaacgattcgcgtcggtgggccgacctaccattgggtacgcgaaagtattctggctggcgaacaggtgttagccggtgcgggtgatgacgccacgccaacgcttctcttacaagctgaagaggaacgcgtggtggataaccgcatgcacgaccgtttttgtgaactacgcaccgctgcgggccatcctgtcgaaggaggacggccgttggtaattaaaggtgcgtaccatgagatcctttttgaaaaggacgcaatgcgctcagtcgcgctccacgctatcgttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggcgcgcgcgttcacgacctcgatggcaacctgatttttgctcataacctggatcgcgacattgccagtgacctgtttggcgtagtcaacgacaatccggacatcattactaacgtttatcgcgacgacgaatggtttatgaatcgccatcgcccggaagagatgcgcttttttaaagaagcggtgttcaaatatgcgctgtatgagccgggattgctggagccggaaggcgtcagcaaagtgttcttcacctgcgattcccatgaaaaacttctgccactggagcaagcgattaacgctcgctggggcgatcgcgtcaatgtcagtttctctaccttaacctgcctggaagtcatggctggcggcgtttcaaaaggccatgcgctggaagcggtggctaagaaactgggctacagtctgaaggattgtattgcgtttggtgatgggatgaacgacgccgaaatgctgtcgatggcggggaaaggctgcattatgggcagtgcgcaccagcgtctgaaagatctgcatccagagctggaagtgattggtactaacgccgaagacgcagtgccgcattatctgcgtaagctctatttatcgtaatcgttctttatttggtcagttgtcaacctgatacttcgctacaatggctactcgttaatcaaagagttttccattgtggcgctacttatcatcaccacgattctgtgggccttctcctttagcttttatggcgagtaccttgcggggcacgtcgatagctattttgcggtgctggtgcgcgttggcctggcggcactcgtttttctgccgtttctgcgtacccgtggcaatagcctgaaaacggtcggcctgtatatgctggtgggcgcgatgcagctcggtgtgatgtatatgctgagtttccgcgcctatctctacctgacggtctccgaactgttgctgttcaccgtactgacgccgctctacatcacgctgatttatgacatcatgagtaagcgccgtctgcgctggggctatgcctttagcgccttgctggcggtgattggtgccgggattattcgctatgatcaggtcaccgaccatttctggactggcttattgctggtgcaactctccaatatcacttttgccatcggcatggtgggttacaaacgtctgatggaaactcgcccgatgccgcagcataacgcctttgcgtggttctatcttggcgcgttcctggtggcagtgattgcatggttcttgctgggaaatgcgcagaaaatgccgcaaaccacgttgcaatggggcattctggtgtttcttggtgtggtggcttccgggattggctactttatgtggaactacggcgcgacgcaggtggacgccggaacgctgggcattatgaataatatgcacgttccggcagggctgctggtaaacctggctatctggcaccaacagccgcactggccaacgtttattacaggcgcgctggtgatcctggcctcactgtgggtgcatcgtaagtgggtcgctccgcgctcttcacaaacggcagatgatcgcaggcgtgattgcgcgctgaacgaataaacgcttccgtaatcggctgacgctgctcgccatcgcgcacggcggcgtacagtcggctccacaagccttcgcccagggttttggtgaccaccagaccctggcgttcaaaactctccaccacccaatgcggtagtgcggcaatacccatccgtgcggcaaccatctgaatcaacaataaggtgttatcgacgcttttcagtgacgggctgacgcctgctggctgaagaaaatgccgccagacatccagtcggctacgctgcaccggataaatcaacagcgtttcgctggcgaggtcttccggcgtgattcgcgttttcgccgccagtggatggtcaggtgctaacaccagacgcacttcatagtcgaacatcggcgaataatgcaggccactgcgcggcagaatatcggaggtcatcaccagatccagctcaccctgctgcaacgcgggctgcgggtcaaacgtcacgcccgatttaaaatccatctccacctgcggccagttcttatggaaattttctaacgcgggcgtcagccactgaatacagctatggcactcaatggcaatgcgcaggcgcgtctgctgcggttcattgcaggcttgcagtgcctggctgatttgcggcagcacctgattcgccagttgcaacaggatttctccctgcggtgtaaaccgaagcggctggcttttacgcacaaatagccggaagccaaggcgttgttccagatcgctaaactggtgagacagggcggattgcgtttgatgcaacgtcgccgcagcggctgcgagtgagccgcagttccgcaacgcttgtagcgttttcaggtgttttacttcgatcatgaaagtccttcacttcggcatgaataatttgcgcttgaggaatatacagtaaccgccaattatggatgtgtaaacatctggacggctaaatactaaaaattccataaggggcatataatgacaattcttaatcacaccctcggtttccctcgcgttggcctgcgtcgcgagctgaaaaaagcgcaagagagttattgggcggggaactccacgcgtgaagaactgctggcggtagggcgtgaattgcgtgctcgtcactgggatcaacaaaagcaagcgggtatcgacctgctgccggtgggcgattttgcctggtacgatcatgtactgaccaccagtctgctgctgggtaatgttccgcaacgtcatcagaacaacgatggttcggtagatatcgacaccctgttccgtattggtcgtggacgtgcaccgactggcgaacctgcggcggcagcggaaatgaccaaatggtttaacaccaactatcactacatggtgccggagttcgttaaaggccaacagttcaaactgacctggacgcagctgctggaggaagtggacgaggcgctggcgctgggccacaaggtgaaacctgtgctgctggggccgattacctacctgtggctgggtaaagtgaaaggtgaacagtttgatcgcctgagcctgctgaacgacattctgccggtttatcagcaagtgctggcagaactggcgaaacgcggcatcgagtgggtacagattgatgaacccgcgttggtactggaactgccgcaggcgtggctgaacgcatacaaacccgcttacgacgcgctccagggacaggtgaaactgctgctgaccacctattttgaaggcgtaacgccaaatctcgacacgattactgcgctgcctgttcagggtctgcatgtcgatcttgtacatggtaaagatgacgttgctgaactgcacaagcgtctgccttctgactggctgctgtctgcgggtcttatcaatggtcgtaacgtctggcgcgccgatcttaccgagaaatatgcgcaaattaaggacattgtcggcaaacgcgatttgtgggtggcatcttcctgctcgttgctgcacagccccatcgacctgagcgtggaaacgcgtcttgatgcagaagtgaaaagctggtttgccttcgccctgcaaaaatgtcatgaactggcattgctgcgcgatgcgctaaacagtggtgatacggcagctctggcagagtggagcgctccgattcaggcgcgtcgtcactctactcgtgtacataatccggcagtagaaaagcgtctggcggcgatcaccgcccaggacagtcagcgtgcgaatgtctatgaagtgcgtgctgaagcccagcgtgcgcgttttaaactgcccgcatggccgaccaccacgattggttccttcccgcaaaccacggagattcgtaccctgcgtctggattttaaaaagggtaatctcgacgccaataactaccgcacgggcattgcggaacatatcaagcaggccattgttgagcaggaacgtttgggactggatgtgctggtacatggcgaggccgagcgtaatgacatggtggaatactttggcgagcacctcgacgggtttgtctttacgcaaaacggttgggtacagagctacggttcccgctgcgtgaagccaccgattgttattggtgacgttagtcgtccggcgccgattaccgtggagtgggcaaaatatgcgcaatccctgactgataaaccggtgaaagggatgttgaccggcccggtgactattctctgctggtcgttcccgcgtgaagatgtcagccgtgaaaccatcgccaaacaaattgcgctggcgctgcgtgatgaagtcgcggacctggaagccgctggaattggcatcattcagattgacgaaccggcattgcgcgaaggtttaccactgcgtcgcagcgactgggatgcctatctccagtggggcgtggaggctttccgtatcaacgccgccgtggcgaaagatgacacacaaatccacactcacatgtgttactgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgtctgtgggtcaacccggactgtggcctgaaaacgcgcggctggccagaaacccgcgcggcactggcgaacatggtgcaggcggcgcagaatttgcgtcggggatgatgagtattaacgagtcattgtaaattgcagtacgataatggcttccagtactggaagccattttgcatgagtgccagattgaagcagatcttcaggagtagaaataaccgaatcgtttttttcgcaaaacacagttttgagtgattccgttcagtaatcaacgctacgttatttattctcacgttgcacgagattgtatcccttttcactaacgtggtagtgaggcatagacttatgcccgctatcctcaataataaccaaaccttcgttagctaatttgttaacaatattaacaacattaccgaatcctggtatttgccttatggatagtgtgcgatcgagattcatccagttccagtttatatctttctcagtcataacgttcagcacgttaagttcatttttagtgatcacgatattctgtaccaaaattgatgagtatcttattgaaagatcacaatgtaaatcatgctcctgtaatggctggatcagaagaggttgtcttgttgttctttgataagattcaatccatattgagaaactctgtagcgtggtttagagttgccctcaccatttacgatatcaaccaacccatgattaaccagctttgttacgatattcgctacgttgccaaatcctggaatatttcgtatagctaaagtacgatccagcaccatccagctccagtcaatatctttctcagccataactttcagcacgttaaattcaactatcgtaatcgtcatttttttgcatccggatgaaataagtcagtatctttaattttaaagtcttctagagttgcagtatgtgcattattccataattcatatccatctaaaccattcggttcacctgtttcccatcctaaattacaataacgctgatactcgcggcattcatgagtatagtagttcagatcgtatttttcaggaagcaattctttatttgctattttttttagccttgaaatcattacatcattagctggatcatgatcaaatctggagatatgcttttcaacaatagcgataccttccctattgattgttacgccatctatcgtcaggttttctattggaccaccggcaaggtcgggattaaatggtcttcctgatactgctcctctggctccgaaatgctcaaatgattccaaatcagggaatctcattcttcccagaacaactccagcaactattgaagcaccagcgatgagtaaccctttgttatccataacttgatcgtaaccagcaggtgcatctcctcccaacttgtttgctgtttccctgaatccttcgatattcccattgtatatgccgccagcagcaagcagtctgccaaccgctttactattgagtgttttgaggccattattatctttagttttttgccgtggtataaacagacggttgtagttatcgggaaatgccaaatgactaaattcagtattagcaatcagatgcctggagagtatatattcataactgacagtgatggtttctgtatccagattgttctcagtaaacaggtgattgattgctgataagagcgcgccgcggagttgaatgttgtaatatttctcctatcgaccaaatctattgatccgatagaagtcaaactccatgaacaactgctcgttattgttaatagcgttaataagtaacggggagcttttgtcaatcaacttacagaaactaaggccatgtaattgtgaccctttgcctgtattcgtaatactattagatagcgagaacgcgaagatttcatcttcatggccaatctgccagcgattacctattgatgcgctcgttccgcaacgagaggaaatacatccttgttgttctccggttatggtcaggtaaatttcatcactcatctttgatgaactctctttattgcttgatgttttaaaaataaacaatattgctatttgtttataattatttactcctcaagttaatggatttaaatatgggaaataaaatgtttcactttagaccagttttcatgaggaaaatctgtaatcattaataataaacatgaatattttgcagtgattaatatttgttatgaatataatctataacaatgaagagttatcagttgttcggtgtatagccagagacgagttcagtttgtgatttttacagggcagttacagccgcaaaattttatggctgatttcaccttcccctcaagcttatctttcttaaaaagagaaataattcttaaattcaaatagttatatacaatctactctctttcttgtgactagcttcacatttcatactgatgcattggaatgaaataaaatttcatgagattttgtgtttgagaaaaattatttcatgaggtgtgaaatggacgcaaagctgtacatcactgagatcatcaatgaattaaccttcgttaaggactctatccgtgaggatgactgcaccaaattgatcgacgctattcagcaaagccagcgcgttttctgctatggcctggggcgtgccggcttttccatgaaagccttcaccatgcgcctgatgcatatgggcaaagaggtttacttcctgacggaaaccattacgccgaactttgggcctggcgatctgtttatcgtttcttccgcttccggtgagacagcacaactggtggcactggcgaaaaaagcacgtcagtttggcggcgctgtggcggtgttaaccacgaatcgacacgccactatcaccgagtttgtcgacgtcatcgtgcaaatcaatgccccttccaaaaatcaaaaagattctgttttccgctcggcacagccgatggcgtcgttgtatgagcaagctttgctggtgattgccgatgcattagtgatgaagatggctgctgaaagcggtgcgccggaaagtgaactgtttaagcgccacgccaatctggaatagtcgtcgccgttatttgctcgataccctacaggagaataaaaatgagcaaaaaaataacatccttgtttaacttcaagaagttgcagaaattttcttctgctctgatgttaccaatcgccattcttccggcggcgggtttgattttagccatcgggatttcatttaacattgagctgctggcgaattgcggcggcctgattttcgccaaccttcctttgctgttttgtgtcggtattgtgattggcctgacaggtgatggttcttcatcactttcagcgattatcagctacatgatcatgaatgccacgatgggaacgcaacttggcattaccgcggagtccgttgcagccagtaacggtgactatgcgatgatcctcggggtaccgacgttacaaacgggagtgtttggcggtttgattgtcgccatctttgtttatctgctctatacccgcttccacaatattgaattgcctcagtttcttggtttcttcggtggaaaacgctttgtaccgattattacggcggtggcggcaattattgtcggctatttattgccgtggctgtggataccggtacaaaaaggtctggcgtcgctttcaacgctggtgaccagtgggcataacgcgaacttcgcggcctttatttacgccgttggcgaacgttcgctgattccttttggcctgcatcatatctggaacgtgccgttttattacaactttggcgactacatgaccaaatccgggcaactggtgacgggcgatattccggtgttctttgcccaattgcgcgacggtgttccgttgacggcggggttgtttatgacaggtcgtttcccaatcatgatgtttgcgttacctgccgccgcgttggcgatgtatcaggaagcaaaaccggaacgtaaggcgctgattaaaggccttttactctccggtgcgctgaccacatttgttaccgggattacggagccgctggaatatgcatttttgtttgcagctccggttctctacatcattcacatcttcttatatgccacttcatttgtgctgatgaacatcctgaatgtgcacattggtcatccttttgctggcggtcttattgatttcgtactgaatggcgttatgccaaaccgcacgccgtggtatctggtgttcctggcaggcgcgggctatgcagcgatttactacaccgtatttcgggtactgatccgcaagttgaatctgaaaacaccgggacgtgaggatgaagagattgccgttgcaaccacattaacgcgcgaagaacgtccataccaaatcatcgaggcagtaggtggtttcgacaatatcgaagatgtggatgcctgcgcaacacgcctgaggctggcgctggtagacgataagaaagtgaatgaaaaacggctgaaggagttgggggctgcgggtttagtgaaactgggtgatggcggtgtacaggtgatatttggcggcaaatcgcaaatcctgcgcgacgaaatcaaaaccgtaatgagcagaccgcgcccgacagaaatgacagtggcctgtgctaactaattcgagattagcgggctggtttcagcccgccagacagagagagctgaagtatgaattcacaattactggctaacgccatccgaatgttaagtgttgatgcgatccagaaagcgaactccggtcatccgggcgcgccgatggggatggcggatattgccgaagtggtctggcgtcgtcacctgcgtcataacccaaaaaatccgcagtggtttaaccgcgaccgctatattcagtcgaacgggcacggttccatgttgatttacgctttgctgcatcttacaggctacgacctgtcgatggatgatattcgcgactttcgtcagctccactcccgcacgccaggtcatccagaatatggttatacgccgggtgttgaaaccaccaccggcccgttggggcagggcgtagctaatgcggtggggatggcgattgcggagaaggcgctggcggcagaatttaacaaaccgggctttaatattgttgatcatcacacatggctatttttgggtgatggctgcctgatggaagggatctcccacgaggcctgtggtcttgcaggaacgctgaagctcggcaatctgattgctatctgggacgataacggtatttcgatcgatggtcacgtagaaggctggtttgctgaagatacggctgcccgttttcgtgcctacggctggcatgtcattgaaggcgttgatggtcacgatccagaagaggtagatgctgcggtgcgtgaagcgaaaagcgtcacggataagcccagtctgctgtgctgcaaaacgattatcggttttggttcgccaaataaagccaacagccacgattgccacggctcggcgctgggtgcagatgaagtggcgctggtgcgtgaacgtctgcaatggccgtatgcccctttcgaaattcctggtgaaatttatgccgcatgggatgcgaccgagaaaggcgcgcaggttcaacaggaatgggatgcactgtttgctgactacgcgaagcagtggccggaactggcggcggagtttactcgtcgcatgaagggtgatttgcctgctggctgggccgagaatatgcagaaatatgtgcacgatctgcaatcccatccggcggcgctggcaacccgtcaggtcagccagaaatgcctcaatcacttcgcggatatgctgccggaactgatgggcggctcggcggacttgtcgccctctaacctgactcgccatcagaaatcggttgatttcaccggggaaaatccggcggggaattacatctcctatggcgtgcgtgaatttggtatgtcggccatcatgaacggtcttgcgctgcatggtgggtttatcccttacggcggtactttcctgatgtttatggaatatgcgcgtaatgcactgcgcatggcggcgctgatgaagatccgctcggtgtttgtttatacccacgataccatcggcctgggcgaagacggcccgacacatcagcccgttgagcaactggcgtcgctgcgtctgacgccgaatatggaaacctggcgcggttgcgatcaggtggaagtggcggtagcctggcaacaggcgattgagcgcaaagatggcccaacgtcgttggtattaacgcgccaacctctggcgcaacagccgcgcaccgctgcacagttggcagagattgcgcgtggtggttatgtactgagtgattgtgacggtcagcctgagatgatcctcatttctgcgggttcagagattgagttagtggtcagcgccgcaaaagcgttaacggaagaagggcgtaaagttcgcgtggtttccatgccgtgtaccgagcgtttcgataatcaggatgcggcgtacaaagagtcggtattgccaaaagctgtacgcaaacgtctggcggtagaagccagcatcgccggattctgggaacgctacgtcggcctggacggtaaagtgatcggcatgacgagctttggtgagtctgctccggcgaatgtgttgttcaaacactttggttttacgccggaaaatgtcctggcgcaggcgcgtgagctactgaacagctaaacctgcacaaggggtgaaaggatgaccttttaccccttgaaacgggagccaagaaactcttcacgggtgcggtatttctcgtaatgcgccttgtttttatacataaacaacagcaccagcatatcaataacgcccattgccggaacgcgagtggagtcgaaggcttcaaagaagattttatcgctgaccgcggtattgagttgatgggtggagagttttgataacggagatttaatatagttagtgatacaaacggatttggcaccgcgctctttcaccactttaaagatatcgaccattaagttggtgctgccagagttagaaataccaatcgccaggtcacgtttccccatagaatatgccgcattaatttgcatttccgggctgacgtgaacaacggtttttaatccgagttggctgaatttataagcaccataaacggccagagggtttgaatttccggcagcaaaaaagaaaatagtgtcgcaattagcaagtagtttgagaatggactcaagcacttcggcattaaaaaattgcgttgattgtattaaatcttcggcctgtttttttaataaaaatgtggccagcgacgttatatcggtaaaatcggtattatcaggatagctattgtcaggattaatgacttcttttgctaatgcaatttttaaatggtaataaccctgataacctaatttcttacaggtgcgtacgatagtcgcttcactggcatggcttttttctgatagttcagtgacactatagttcacgacttcatgtgcgtggctaagaatatagtcagcgacctttttttccgcctgatgcagtgtagggtaattgctttgaatcagactttttacggttatgttattcataattagtaaatttcattctgacagaaagtgctgattataacatagttttcaggcgtggataggtgtgaaaaaaatgaaggtgtgcagtgaacgtaatgattaacagaccggttaattttcatgaattacgtcaactgcacaaaaataatttaaacgggtgctctaattaaagcaaaacttatatttttatcattgtattgtcaattaaatacaaattgtgtcattaattgtgggtttcttaaatattctatgcaccactgacaggctttgcccataccatcggaacgagcggcaagaaataacttggtggcgtgtttatgttcgcgcattggctttttaagcaatttaccgctgttcaataacggcaatgccagatgatgtggaatataaccaataccgacgttttgttctattaaggcgattgccgtagcgaagtcaggaacaaaaatgggtttttgtccttccaacaaccaggcttgcatcggggggaagttaacggaggtatcgcggatacaaaccgctggatagtgacgcaattcactgttttctaatggatgccgcttcgctgccagtgggtggagtgggctgacgacaaaatcccattccatttgtccgaccggttcgctaatgatgccttcactgcttggtactgcatgaggagcaccgtagaccagatcagcacgcttactgtacagcgcatcccagcagccgttgtatacctcaagatctaccgtcagtgttgttgatgtgaattgccgttcaaaatctcgaataaatgccaccagcaaatcaccaggaataatattgttcaccgcaattgtcagttcacgctcaataccatcgtgaatcagcactgtgttgcgctttaatgcttccaggtcgccaagaatagttttgctatgttcgatgaagtaacttcccgctggcgataattcaatatagcgtcccttacgaatgaacagttcaacgcccaggctctcttccgctttcttgatggtgtaactgatggcggaagggactttatttaactgctcggctgcggtggtaatgctctggtgtctggcgaccagatgaataacacgaagcgtttcgtctgagatgaacataaggctccctggtcagtggtaaagtggctgaatctctccagattcagccgtaatcattgcctgagtatacccaggaattagcggtgttgacttgcccgactgagaatcgcatacgcgatacatgccaccagaatcgagtctaccgaagggatcgtcgtcagggtgaataagccttttacggtcataaagccaaccgctgcgcctatgatccatgctgcgaatgtcagcactttaatctgtgactcctgggctaacactgactcttgatagccattacggcgataaaggaaaaagtcagcgatataaattccggcaacgggtggcgtggcgatacccaggaacagcagaaacggaataaaccacgccataatatccatactgcctacgatggcggaaaggatacccagcgccacggtaatctgccatttgggaaagcgggtaagcagtgtggaaaccaccagcgtgccctggaacatattgcccgcgttaccggtgacgcaggcgaaaatcaacaacagcgccgcaggcagaaccgcaccgaataccgccatcgcacccagtaaagatccctgaccactaatggcgctcggcgttgcacccgcccagtagagcagagggtaggcaaccagaaacgtcacgcctgcggcaatcagcgcatgtttgcggttatgcacaaaactaccgaaatcaggcagtgtggcaaccagcacaataatggtgccaacaacggtggaaacggcgacacctgtattcatctccacaatcgccgctggtactgccacttcggtatgggttgccacatagaggatgtaacacagcaccagcgcgataaccggcacggcaacctgggcaatttttcccagaacggcaaagccaaatgccgtagaggcgacaaaaatgacacagccagccgccactaacagtgccagtggaacttccagtccatgttgagccagtaagtcatgtaccgaatgaccaaacatattggcggtaacggcaatccagccgaacagacttatcgccatcaaaatgttaatggcgatggcccctttttcgccaaacgaatatttcacaatgccatacgttggcaggcgggctttttctcccacgctaatggtgatggctgaaagtaaggtcagaatgacgccgcctaacaatacgacgctaattaaactgccgctggaaagttgattgccgaggcttgaggatgacaacagcacaggtgtgacggcaatacccagcaaaatcatggcaatacgcaatcctgatgccgtattcagattctcttcttttttacgcatagtatgttccctttataaatgcgcgttacacagtatgaaaatgcccggtgtatttgcgccagctacccagttctgtaatttcccgttggccttcggtcagccagttttctgccagtacgcccagcacttcgctaccatcggcaagtttgattttgccaattgccagcccagcgggttcgctcattaacagagcggcaaaactggccagcggtaattgccaaatttctacgtcgacgtgtgttcctccttcattcacgcgaatcattcccggatggcgatcattaatactccacaaccggtaatgggcgtcagttcggtcttcacggacaaaaataccgcccgctttttgcatatttgggttgagttccaggccgcgcatcagcgttccgttaacggctaaaagcgttgtagtcattgtgttctccagagaattaaagggttatccatgtaccgctctgatgcgccagggctgcttttatggtttgcggtgaagtaatcaggccgctggcctgtttgccttgttgctggctggcattgatgaaatcaacaatggcttccactttgggttgcatactgccgacaccaaactgaccttcccgcaacagcgtttgcgcttcggcaacgctgatagcgtcgagccactgttgttgtggtgtaccaaagttaatcgctactttttctacaccggtggggatcaccagcagatctgcgcctaactgactggcgagcagcgcggaggccagatctttatcgatcacggcttctacacctttcagttgttgcccgtctcgcaccaccggaataccgccgccgccgcaggcaataaccagatatccctggcgcaccaggtgagcgatggtgtcgtgctcaataatttccagtggtgcaggagagggaactgtacgccgccaaccacgcccggcgtcctccatcagcgtccagccgagttgttgttggcgttgttgggccgttgcttcatcgagaaacgcgccaattggtttactggggctggcgaaagcatcgtcatgtgggctgactcgcgtttgtgtcaccagggcaattaccggtttgtttatgccacggcgagccaattcgttatgcagcgctttctggaacatgtagccaattgcaccttgtgtatcacccacggcgtaatcaagtggaaccggagaaacttcgttactggcgagttcagagcggcgcagaataaagcccacctgcgggccattaccgtgggttagtaccaggtcccatccggcttcaaccatatcaacgatatgttgcacgctttccatcactgcaacatattgatcgggaatactattgcgttgctcgtcctgaatgagcgcattgccgccaaccgcgacgacagccagtggcttaaccatgatggttctcctttgcgacgatctccgccagtgcacgtacagcggcgacaaaacaggccatcggcgcagtggtgatcccggcaccaatttgcccgacccccgcttgtttgtgggcgatacccgtattgatgaccggtaaaatgccgcgatcggtcactttacgcgcatcaattcctgctgcggtgggggcaaaattgagggctggaagtgtaaatgcggggttaccgccgagggtgatggcttgcatccgacggctgttattggtggcatcggcaggggtgcctcccacaaatttgacgatcgccggagacgacgccatcgcgaagccacccatacctgcggtttcagtaattgcgctatcacccaggtcagcagcagcgtcgtcaacgccaaatccggggaagaacagaccttcaacggcattggcaggagcctggaaccagcgatcgctagtaccggaaagccgaataccaaaactcaccccgttacgcgccatcaccgtaaccattgaactgaacggtacattggcggcggcatccatcattgctttacaggcggccatcgacagattgaggaagaagtgatcgttaccggtgataaatgccacgacgcgctggatatgttcctgtggaagagagcaggccagcaatgccgggagcaggcgcttaatcagcaaaccggtagcggcagcattgcggttatgaacttcatcccccatatgcagcgcctgcgccattaatggcttgagttccagctcgccgtgttgtgcgattgctgctttcattgccggcgccagttcatcgcgcatccaggccagacgattgagaacttcatcgttattggcgccaaaacggagaaccttacccagaccttcattgaaattgctaaaagtacgatggccgttggttttgttttctaccacccataacggcatcgacgggctgatgatgcctgccattgggccaaccgcgtgataatgatgacaaggggcaaggtcgatttcgcctgcgtttatttggttttcagcgtcttgctggctggtggcccaaccttcgtacagcatggcaccaataatcgccccttttaccggaccacacatctcttcccaggcaatcggcgggccagagtgcaaaatacgtttttgttcagccattgctggaatggcctctttagcgagcatgacatccaccagcatgggctgtgcttcgagataacgtgtcatggcgatttggttggcattttctaccaggggatgacgtagcaacgatgccagatccaatccagcgtcaatatcgccttgtgctggtggctgccagttgagtgcaattgcgcttcccccggcatgttgaatattgtcagcaaaactgtgtagtcccgcgttcacaaccttcaaaggctgattaaataaggtattcatgcgtttagcccctttttctgcaactgagtctgtgcaacggtgctggcccatagcgccgcctgtgcattgctgctggcgatgatgacccctgcattttgtagtgctcttatctgctgactgcgtatttgcggatcagcttccgttccgcaaacgtgcgcaatcagcaacggtgcgttattcatgtcgatgtgtgaaagttggtccagtaattcgctggcaggcgccgtggaagcgccataaccaagtaccaggtcgaataacacgacggcagtgtgtgagtcgttgagttcgttgagcagacgttgattgcgcagagtcgggtcgatcattggatgcggtttgccacgggtgaaatcatcgtcgcccatatcgatcaacgtgtgatcttcgctttgccagatatttgccagagcacgattacccgcaactggcgtattggaagctgcgctgaatcccttttgttggcagataagttgcgcttcgtagcagaaggttcctccggcgaaaacaccgcgtatcgcctggcgatgggctggcaggcgctgacaggcgttttgtaacattgtgagatcggcgcaggaaatctcggtctcgacagccggaagtggctgagcattcagtaacgctacggcgatatttgcggcgctggcaagtgtggtggccgcggtgatattgggacgtgccagatcatgcggattcgcaccgaggaaattcaccaccacgggttttccacaagcctcggcgcgctccagaatagtctgggcaacgatcggtgaaggcggttttgaaatcagcacaatcacgcgagtttcatcgtcttgcgccagcgcatctaaagcgaagagcatcgatattccaccaatctcttcactgagatcatgcccaccggttcccaacgcctgagaaatacccgctccgagctggtcgattcggcaagtcacttcctgtagcccggtgcctgacgcgccaataacaccaattgctccgcgtttcaccacattagcgaagcctaacggaatgccgttaacaatggcggttccacagtcaggtcccattacgatgcgctgacgttctcgggcaagcgttttgatagatttttcctgcccgatactgacgttatcgctgaacatcatcacgttcattccgaggtttaacgctttaattgcttcggcggcggcgtagtctcccggtacagaaatgagtgccaggttggcttcgggttcggcttccagtgccatttccaggctgaccttttccggtgttttaatgccactatccgtttcatcatcgggtttgctggtcagacgttgctgggccagtaccagtgcttcattgcaaatatcttcttcacccatgactgcaatcactaaatcattgggactggcgttgatttcgttacccagacccgcatcgcgcaattgttcgagattattgggcgttcccatgacgaccgaggcctgttgaataccgggcaacttgctgatttgcgcggaaatctgcatcagagaaactgagtcctgataaagattactgaaaactttatatttaactttcatgctgttacgcctgtttcattccgcccgatagcaaaattcgggcaaagcatccccgtgtagccccataaacgggctacgggagaaaaggttgaaatcaattcatggtgttcagggttcgaaagccatgcagcattcctgcaaggcaatctactcctgacgttgcgccaaattgcatgacctgttctgcacaggatgcgattgtcattgccgatgcgctcccaaccagttgtgcgagtaactggcaaatcggttctgaaaaatgtccctgaagcgcacgctccagataatgacgactgatatccgtggtgttgtgcgcatgttgatcaattgcctgctgcaaccggtattgatgatcggcaagtggtgcagggagttgccataaccagagcgctgccagatagcccaacaaatagtcatctccatcgggcgttaagcctttaccaaagccgatcagttgtggcacctggcgttccagcgcatctggatgctccataattgctaatccctggtgcgtgagactatccggcaggtgcaatgtgctttgaacgttatgttccagacaaaataaaagccgttgcgatgccatcgttgggtagtgctggaaaaccaaagggaatgcctcaagtgtcagcattctccccacaaatggcgactgccagagcgttgcgttttcgagcgccacacaaaatcgaggtgtccgcagtaagccttgggttaactgaatgggatctgaatgggcaatctctcttcgccagtcccaacattcaggtagccagactctggcagcatcagggagattcagatacgtttgcgcacacaacagagtgatgaatgttcccgcgtctgaatacagatttaccgcatgtttaaaagcgctatgtagacgtaaatcttgcgtttcattctgcgggaaaagatatcccaacgacgatgcgcaaagcgtaacctgtaccatcggcgttagccttccagacctgcaataatggctttggaatcagtaacccaaccgaaaatggcaccttgtgctttgatcatctcgagggcgtatttctggaattccgggaaataggagccgacacaatcttccgggataatgcattcatagccacgatcatttgcttcgcgcacggtggtggttacgcaaacttcggttgttacaccacaaactatcagcgtcttgataccgtggttttgcaaaatcagatgtaagtcggtttgataaaacgcgcctttgccaggcttatcaatcaccggttcgcctgccaccgggtacagttcaggaatgatgtcatgacctgcttcacctctgaccagaatgcgtcccatcggtcctggttcaccaataaaggtttttccgccgcgcgtcagtttggctggcgggcagtcgcttaagtctgcacgatggccttcacgagtatgaataaccataattcctttttgacgtgcggctgccagcacctctgtacatggtgcgatagccgtgcgtaccagtgaaacatcattgcccagagcctcaccgaagccccctgcttcgacaaagtcacgctgcatgtcgatcatgaccagtgcagttgtgcgcggatcaaaaggtaattcaaagggttgagcctgaaaaatggattgcgtcatggtaaatctcctgtctgatgtttaaacgatccagttgttctgagaacgagtattcaggagaaaagcgacacaaaacaggaaaaaagtttgccgcacagcaacgaaatttttgcattcagcaggtggtgtgatgacgaatgtgaagggagtcaaagagtggcatacagcaacaaattttttgatgctgtatggttttgagattaaaaaaatcgttgaaattgtgtgagcttaatcatcagatttagcgactatggcgttactttttaacaccatactgtgtaaaccattccaacattcgctgccagccgtctttcgcagattcggcatgatagctcggacgataatcggcgttgaacgcatgccctgcatccgggtacacgataatctctgctttcgcgtttgctgcccgcagcgcctggcgcatcgtttccacgctctcttgcggaatgctgttatcctggccgccatataagccgagaaccggagcgttaagatcggttgcgatatcaacaggttgtttcggtgaattcagcgacttatcgcccgtcagtttgccgtaccacgccactgcggcttttagctgtggattatgcgcggcatacagccaggtgatacgtccaccccagcagaatccggtgatcattaaacgatgaacatcgccgccgttgcgggaagcccaactggcgacatgatcgagatcggccagcacctgcgagtcaggcacttttgctaccagaccgctaagcaacgtggggatatcggcaaaatcattcggatcgccttcgcggaagtaaagttcaggtgcgatagccagatacccctccagcgccagacggcgacaaatgtcgcggatatgttcatgcacgccaaaaatttcctgcactacaatgaccactggcagtgggccatcgctttgctttggtctggcatggtaagcaggcatgttatccccttgtgaagggatagaggtgaagcccgccacaatcgcgtcgtccggagtctgaacgatggtcgaagcgagaggcgatgcagcaggtgcaaatccagattgttgtgttgttgccatggtattctccgtacccttataaaaatgttgcgcaatgttaactatagtcagcatgcaacaaatcacattgcctgaatcggctcatcttttatgcagtcctgcagaatgaagagtgatttatgtgatttgcatcacttttgatgggtaaatttatgcaacacattttcgtcatggtgatgagtatcacgaaaaaatgttaaacccttcggtaaagtgtctttttgcttcttctgactaaaccgattcacagaggagttgtatatgtccaagtctgatgtttttcatctcggcctcactaaaaacgatttacaaggggctacgcttgccatcgtccctggcgacccggatcgtgtggaaaagatcgccgcgctgatggataagccggttaagctggcatctcaccgcgaattcaccacctggcgtgcagagctggatggtaaacctgttatcgtctgctctaccggtatcggcggcccgtctacctctattgctgttgaagagctggcacagctgggcattcgcaccttcctgcgtatcggtacaacgggcgctattcagccgcatattaatgtgggtgatgtcctggttaccacggcgtctgttcgtctggatggcgcgagcctgcacttcgcaccgctggaattcccggctgtcgctgatttcgaatgtacgactgcgctggttgaagctgcgaaatccattggcgcgacgactcacgttggcgtgacagcttcttctgataccttctacccaggtcaggaacgttacgatacttactctggtcgcgtagttcgtcactttaaaggttctatggaagagtggcaggcgatgggcgtaatgaactatgaaatggaatctgcaaccctgctgaccatgtgtgcaagtcagggcctgcgtgccggtatggtagcgggggttatcgttaaccgcacccagcaagagatcccgaatgctgagacgatgaaacaaaccgaaagccatgcggtgaaaatcgtggtggaagcggcgcgtcgtctgctgaaataaaaaaacgctccccaacttcggggagcgataccagttattgacgccgtaaacgcattattttgcggattattggcgtcagtagcgtaaaggcggccagagtcagcaatgccagagtgatcggtcgggtatacagaaagtcgagtgaaccccctgaaagcgacagcgcacggcgaaaattactttccgccattggccccataatcaatgccaggaccactggcgacgccggatatccccctttctgcatgaaatagcccactacgcccgcaatcaacataatgccgacatcaaacaggctgttgttcagtgcataagtcccgaccacacaaagtgcgaggatcatcggtgtgagaatattgccgggaattttcaccacattaccgatgactttcaaagagagcagtccaagaactagtagcatgaagtaacagaagatcatgccgacaaacagcgtataaaccatatcaccgtggtcggtaaacatcagcgggcctggttgcattccctgtaacgttaacgcgcccagcatgatggcggttaccgcatcgccagggatccccagcgtcagcataggtaacaatgcgccaccggtgcagccattcgcgcctgcctcacaggaggccacagctttaatttcacccttaccaaagttttctggtgtcttactgaaacgacgagtttcgttataggcaacaaaagctgcaatatccgcccccgcaccggggatcatgccgataaaaacccctaatcctgatgagcgcaaaatggttaatgcgatgcggcgtagtgtttgccagggcagtaacagactgccgatagccaccttcgcgccccgacgaatttgctggttttgctccatagagcggaatgcttctgaagcagcaaataaaccaatcatcaccgggataaatggcacattcatcagctccacaaatccacctgtaaaccgtggaaaaccgcccattggatcaaggcctatcgttgcgatcagcaatccgccaaccccggcaatcagccccttaatcagcgactcaccggaaatactggcaataatgctcagtccgaaggttgccagggcgaaggactccgaggcactaaatttcagcgcccaactggcaagtaccggagagagaaacatcagcacgataatgctgagcgttccgccactaaaggaagagaacgtggcggcactcaatgccagccctgcttttccctgtttcgtcagctcataaccatcaatagcggtggctgcggcggcaggtgttccgggaattttgagcaaaattgcggtgatagaaccaccgtagacgccaccaaaaaagacgccgcaaatcatcaacaatccagaaacaggctccatgccgtaggtgaaaggcagcaaaatcgccacacccatggtcgctgtcagaccaggcaaagcgccaatcacaatacccagcatcaccccaaaagtggcaaacagcagcgcctgaggattattgagtaatgtcgaaaaaccctgagttaaaagttcactttcaaacattgctggcccctgttattcgaaaaatgtgccgacaggcaatggcacctgtaacgcttcgacaaacagcaaccagaggattgccgttaacagcagcgcaatacccggtgtgagtacccatcgcctgtagcccatcaacgtcataatgacgatgaggaaaacaggagtagtaatgagataaccgcagtagctcatcgccacaatataaaacgcggttgccgcaattcctgttgctgttttcctgaatgccggtttttcctgtgcgttggcgcaagaggctggttttgcctgcaaaagatcgcgtatcaccagcaagacagcgagcacaatcagggcacaggcatagaaggtagggaaggcacttgcaccgggatccgtttcaatggcagttgctggaaaatcagcggcattaatcatcaccgcgccagcaaccacacaaagtaacagcgccaccaccatcgttgatgaaaggcgcttgcggtgcggtacggcgagttgagcaacagactgttttgtgttcatcaaccgtacctcaggtttattttttcaggcccaggcgagtcagcaactcgtcaaagtacttttcctgttcgctgatttgggtctggaagctggcagcgtcaagccatgcatagttgagattcaacttttgcagtgcatcctggaatgcaggctcttcagccgtctcttttgctgcctttgccagaacatccaccacatcctgctgcgttttttgcgacacaatcaggccgcgccaggtgccgatggagagatcaacgcctttctcttttaacgtcgggacgtcaggcatggttttcattcgctcatccgccatcactaccagtgtcttcagcttgccgccattcacatggttgataacttctcctgggcttacggaaaccgcttcaatgtgcccacctaacaggcctgtaatggcaggggctgcgccgtcatacgggacatgagaaaactttgcgcccgttttgtcttccagtgcagctgccgccagatgccagatagctccggtgcctgagttaccaatgcgtacttttccgggattcgctttggcgtaagtcataaattcttcatagctattccacggcgcatcggcacggactgtgatagcagccggatccgcattcagacgggcaatgggtttaaagtcgctggttttaaaacgcaccattccgaggctgggaagggtggttagttcaaccgtgcctaaaccaattttgtaaccgttagggcgggcagcggcgatttcactcaggccgatagcaccgcctccgccaggtttattgataaccccgatgctgacgggtaaatggtttttggcggcatcagcaaaggcacgggcaaccagatccgtaccgcctccggcagcgtagggaacgactaactcgatctgtttggttgggtaggaggctgcctgtacaggcgcaatgctgagggcagcgcctgcaagaagtaccattgcagccatttttttcggtaaggtaagatgttttatcattgcttttatatccttatttatcagttagttgctatttaaattgttccatgcgttcataaacagtactgcattttcatagacttgctctggcgtcatgccggggcgatatagcgcagaaccgaggccaaagccgtttgcgccgtggctcagataacgcgccatggtttccggtgtgataccgccaaccggtaacatcggaacggattgtggaataaccgcacgccaggctttggtaacttctggcgtaatttgttcagccgggaacagcttgatggcattagcaccatgttcaatggcagcaaaggcttcggtgggcgtggcgacgccaggcgcacaatacatacccagcgcacgggcgcgacggatcaccgcagtatcgcaatgcggcatcacgataatctggcccccagcctctttaaccgcaaccacctgctctaccgaaagcacagttccggctccgaccaggcagtccttaggcagggcgtcgcgcagtaaactgatactttgcaacgcctccggcgagttcataggaatctcaatcaggcggaatccggcggcgtacagtttttcaccgatggcgacaatctcatccggtttcacaccgcgtaaaatggcgactaacccggttttttgcaaaagcgtattaaatggcatgggtacattccctggcgttggtggacagtaacccggcagcgtgggcgattcgccataatccctgttcagtggcattgggaatggcgtgtatctgtctgtcgggaaaaacgtggctgaatgcttgtgaatagcggctgttcagatttgcgctaccgattaaggcgatcggtgttgtggcgggtaaatcacgtagcaaactggatgccagaccacataattcatggcctatcagtaatccggaaaggtaatccccctgcgaggacgacgtaagattactggtcagcaggcgcgaacgggtcgaaaacagcgtcgataataatccggtctgatgatgctcttgtgctgctgtcagcccgtgggtgaaggcatcccagtgcggttcatctccaggatgcatggtggcaccgagaatcgaatggcgggataaaacatcaaataactcgcccgtcataaaggttcggaaatcggtaatggtgttgttttcaactactgcccatttcgcatgtgtgccgggtaagcctatcagcactggcataccctgatggattgcgttttgcagggccggttccatcgagatagcaccgaagatttgtgtctcttcgccacgcatcacttcgggcatttcaccttctttaatcacgccaggaatgatgtgcagcattgtctgctgctggtggataacaggcgtcaactgcttcgccagaccctcgagagtgaccgggcaaggtaaataagctgctggttgccacccttgcgcactgccgagcatgccgcaagccagtaccgggcatggggtttgtgccagccagtcgctgcagacacgtaaaaacgtatcgtggaaagtgtcctcacgtgttgctgcctgggagggtaatttcatgatcccccaggggaattcacgtttttcttgtggatttggtgattcgccaaaacgccatgcccgaagcgatgacgttccccagtccagggcaataaatgagggtgctcccggcattagtcgtttcctttaatcatggtttatttatctttgcggacgtgcttaccccagcccagttcagcggatatctcttctgcacaggatttgacgtaaggtgccagttcttccagacgcgccagcgacatatacgtggtggtactggcgacagaaatagccgccacaatttcatcccgggcgttgtaaaccggcgctgcaacgcaacggatagtcggctcgttctcttccagatcaaaagcaaaaccactggcggcataacgacgcatgttctgaataaatgcgcccagttttgtttcatcaccacaggtcttaaacagcgtgcgccactcttcttctgttcggttgaggatcaatgccttgccgatgccggtgattgccagtggcatgcgatggcctgggcgtgagcgcatttccagcccgcgctgactgttgatcttctccagatacagcacttcgtcgccttcaacgatccccagatgcacggtgtccagggtgtaacgggcaaggcgttgcaaaacgggctgggcaatttcgtacagcgaggtgctttccagtgctctggcaccgaattcgatcagtttggcacccagttggtagccctgcgttgggacatggcgcaggtagcgttgttccaccagaacggtgactaaacgatgggttgtgctccgggtcgtgccggtgaactcgccgatactttttaggtcatggcagccgttataaacagcattaagaaccgccagtccacgtaataacgtttgtgcgcctgcggtggttgaagaggtttctgccatacgtttctcctgatgatattgctgaagtgttccacataatgacgtggggaaaaggtgatatatcccacaatataaactccatctcatattgtgggataaaataatgaaaattaacgatcgttttgcgtagcgcctcgcaggaaacttctttcaaactggacgtttgtacagcacaattctattttgtgcgggtaagttgttgcgtcaggaggcgttgtggatttctcaatcatggtttacgcagttattgcattggtgggtgtggcaattggctggctgtttgccagttatcaacatgcgcagcaaaaagccgagcaattagctgaacgtgaagagatggtcgcggagttaagcgcggcaaaacaacaaattacccaaagcgagcactggcgcgcagagtgtgaattgctcaataacgaagtgcgcagcctgcaaagtattaacacctcgctggaggccgatctgcgtgaagtgaccacgcggatggaagccgcacagcaacacgctgacgataaaattcgccagatgatcaacagcgaacagcgcctcagtgagcaatttgaaaaccttgccaaccgtatttttgaacacagtaatcgtcgggttgatgagcaaaatcgccagagtctgaacagtcttttgtcgccgttgcgtgaacaactggatggtttccgccgtcaggtccaggacagctttggtaaagaagcccaagaacgtcataccctgactcacgaaatccgcaacctccagcaactcaacgcccagatggcccaggaagcgatcaacctgacgcgtgcgctgaaaggcgacaataaaacccagggcaactggggcgaggtagtattgacgcgggtgctggaggcttccggtctgcgtgaagggtatgaatatgaaacccaggtcagcatcgaaaatgacgcccgctcgcggatgcagccggatgtcatcgtgcggttgccgcagggaaaagatgtggtgatcgacgccaaaatgacgctggtcgcctatgaacgctatttcaacgccgaagatgactacacccgcgaaagcgcgctacaggaacatatcgcgtcggtacgtaaccatatccgtttgctgggacgcaaagattatcaacagctgccggggctgcgaactctggattacgtgctgatgtttattcccgttgaacccgcttttttactggcgcttgaccgtcagccggagctgatcaccgaagcgttgaaaaacaatatcatgctggttagcccgactacgctgctggtggcgctgcgcactatcgccaacctgtggcgttatgagcatcaaagtcgtaacgcccagaaaatcgccgatcgcgccagcaagctgtacgacaaaatgcgcttgtttgtcgatgacatgtccgcgatcggtcaaagtctcgacaaagcgcaggataactatcgccaggcaatgaaaaaactctcttcaggtcgcggaaatgtgctggcgcaggcagaagcgtttcgcggtttaggggtagaaattaaacgcgagattaatccggatttggctgaacaggcggtgagccaggatgaagagtatcgacttcggtcggttccggagcagccgaatgatgaagcttatcaacgcgatgatgaatataatcagcagtcgcgctagcccattgggggtagttaagccgggtagaaatctagggcatcgacgcccaatctgttacacttctggaacaattttttgatgagcaggcattgagatggtggataagtcacaagaaacgacgcactttggttttcagaccgtcgcgaaggaacaaaaagcggatatggtcgcccacgttttccattccgtggcatcaaaatacgatgtcatgaatgatttgatgtcattcggtattcatcgtttgtggaagcgattcacgattgattgcagcggcgtacgccgtgggcagaccgtgctggatctggctggtggcaccggcgacctgacagcgaaattctctcgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtacttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaaaccatgatgcaggatgccggattcgaaagtgtcgactactacaatctgacggcaggggttgtggcgctgcatcgtggttataagttctgacaggagaccggaaatgccttttaaacctttagtgacggcaggaattgaaagtctgctcaacaccttcctgtatcgctcacccgcgctgaaaacggcccgctcgcgtctgttgggcaaagtgctgcgcgtggaggtaaaaggcttttcgacgtcattgattctggtgttcagcgaacgccaggtcgatgtactgggcgaatgggcaggcgatgctgactgcaccgttatcgcttacgccagcgtgttgccgaaacttcgcgatcgccagcagcttgccgcactgattcgcagtggtgagctggaagtgcagggtgatattcaggtggtgcaaaacttcgttgcgctggcagatctggcagagttcgaccctgcggaactgctggccccttataccggtgatatcgccgctgaaggtatcagcaaagccctgcgcggaggcgcaaagttcctgcatcacggcattaagcgccagcaatgttatgtggcggaagccattactgaagagtggcgtatggcacccggtccgcttgaagtggcctggtttgcggaagagacggctgccgtcgagcgtgctgttgatgccctgaccaaacggctggaaaaactggaggctaaatgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacctttaggtgagcgactacgactggccctgcaagaactgggaccggtatggatcaagttcgggcagatgttatcaacccgccgcgatctttttccgccgcatattgccgatcagctggcgttattgcaggacaaagtcgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagttatccgcccggatattttgccggtcattaaagcggatctgaaacttatttaccgtctggctcgctgggtgccgcgtttgctgccggatggtcgccgtctgcgcccaaccgaagtggtgcgcgagtacgaaaagaccttgattgatgaactgaatttgctgcgggaatctgccaacgccattcagcttcgacgcaattttgaagacagcccgatgctctacatcccggaagtttaccctgactattgtagtgaagggatgatggtgatggagcgtatttacggcattccggtgtctgatgttgcgacgctggagaaaaacggcaccaacatgaaattgctggcggaacgcggcgtgcaggtgttcttcactcaggtctttcgcgacagctttttccatgctgatatgcaccctggcaacatcttcgtaagctatgaacacccggaaaacccgaaatatatcggcattgattgcgggattgttggctcgctaaacaaagaagataaacgctatctggcggaaaactttatcgccttctttaatcgcgactatcgcaaagtggcagagctacacgtcgattctggttgggtgccaccagataccaacgttgaagagttcgaatttgccattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaactggtttacgacagtttgcgccagggcaagtatttacagcatagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctgattttttcatcgctcaaggcgggccgtgtaacgtataatgcggctttgtttaatcatcatctaccacagaggaacatgtatgggtggtatcagtatttggcagttattgattattgccgtcatcgttgtactgctttttggcaccaaaaagctcggctccatcggttccgatcttggtgcgtcgatcaaaggctttaaaaaagcaatgagcgatgatgaaccaaagcaggataaaaccagccaggatgctgattttactgcgaaaactatcgccgataagcaggcggatacgaatcaggaacaggctaaaacagaagacgcgaagcgccacgataaagagcaggtgtaatctgtgtttgatatcggttttagcgaactgctattggtgttcatcatcggcctcgtcgttctggggccgcaacgactgcctgtggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaattacgccaggctgcggagtcgatgaagcgttcctacgttgcaaacgatcctgaaaaggcgagcgatgaagcgcacaccatccataacccggtggtgaaagacaatgaaactgcgcatgaaggcgtaacgcctgctgctgcacaaacgcaggccagttcgccggaacagaagccagaaaccacgccagagccggtggtaaaacctgctgcggacgctgaaccgaaaaccgctgcaccttccccttcgtcgagtgataaaccgtaaacatgtctgtagaagatactcaaccgcttatcacgcatctgattgagctgcgtaagcgtctgctgaactgcattatctcggtgatcgtgatattcctgtgtctggtctatttcgccaatgacatctatcacctggtatccgcgccactgatcaagcagttgccgcaaggttcaacgatgatcgccaccgacgtggcctcgccgttctttacgccgatcaagctgacctttatggtgtcgctgattctgtcagcgccggtgattctctatcaggtgtgggcgtttatcgccccagcgctgtataagcatgaacgtcgcctggtggtgccgctgctggtttccagctctctgctgttttatatcggcatggcgttcgcctactttgtggtctttccgctggcatttggcttccttgccaataccgcgccggaaggggtacaggtatccaccgacatcgcgagctatttaagcttcgttatggcgctgtttatggcgtttggtgtctcctttgaagtgccggtggcaattgtgctgctgtgctggatggggattacctcgccagaagacttacgcaaaaaacgcccgtatgtgctggttggtgcattcgttgtcgggatgttgctgacgccgccggatgtcttctcgcaaacgctgttggcgatccctatgtactgcctgtttgaaatcggtgtcttcttctcacgcttttacgttggtaaagggcgaaaccgggaagaggaaaacgacgctgaagcagaaagcgaaaaaactgaagaataaattcaaccgcccgtcagggcggttgtcatatggagtacaggatgtttgatatcggcgttaatttgaccagttcgcaatttgcgaaagaccgtgatgatgttgtagcgcgcgcttttgacgcgggagttaatgggctactcatcaccggtaccaatctgcgtgaaagccagcaggcgcaaaagctggcgcgtcagtattcgtcctgttggtcaacggcgggcgtacatcctcacgacagcagccagtggcaagctgtgactgaagaagcgattattgagctggccgcgcagccagaagtggtggcgattggtgaatgtggtctcgactttaaccgcaacttttcgacgccggaagagcaggaacgcgcttttgttgcccagctacgcattgccgcagaattaaacatgccggtatttatgcactgtcgcgatgcccacgagcggtttatgacattgctggagccgtggctggataaactgcctggtgcggttcttcattgctttaccggcacacgcgaagagatgcaggcgtgcgtggcgtgtggaatttatatcggcattaccggttgggtttgcgatgaacgacgcgggctggagctgcgggaattgttgccgttgattccggcggagaaattgctgatcgaaactgatgcgccgtatctgctccctcgcgatctcacgccaaagccatcatcccggcgcaacgagccagcccatctgccccatattttgcaacgtattgcgcactggcgtggagaagatgccgcatggctggctgccaccacggatgccaatgtcaaaacactgtttgggattgcgttttagagtttgcggaactcggtgttcttcacactgtgcttaatctctttattaataagattcagcaatagcatggagcgagcctcgccatcgggctcggtgaaaatggcctgaaaaccttcgaatgcgccttcagtaataatcactttatcaccaggatacggcgtcgatggatcgacaatatctttcggtttatacactgataactgatgaatcaccgccgatgggactatcgctggcgacgcgccaaagcgcacgaagtggctgacaccacgagtcgcgttgatagtcgtggtatgaatcacttccggatcgaactccacaaacaagtagttggggaacaatggctcactgactgcagtacgtttgccacgcacgattttttccagggtgatcatcggtgccaggcaattcacagcctgtctttcgaggtgttcctgggcacgttgaagttgcccgcgcttgcagtacagtaaataccaggattgcataatgactcttatccgtttaatcggggcgcaaggatagcaaaagctttacgctaagttaattatattccccggtttgcgttataccgtcagagttcacgctaatttaacaaatttacagcatcgcaaagatgaacgccgtataatgggcgcagattaagaggctacaatggacgccatgaaatataacgatttacgcgacttcttgacgctgcttgaacagcagggtgagctaaaacgtatcacgctcccggtggatccgcacctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcgactgcgtggtgcaccctgccaacaaaaaatcgtctctggcgatgacgtcgatctcaatcgcattcccattatgacctgctggccggaagatgccgcgccgctgattacctgggggctcaccgtaacgcgcggcccgcataaagagcggcagaatctgggcatttatcgccagcagctaattggtaaaaacaaactgattatgcgctggctgtcgcatcgcggcggcgcgttggattatcaggagtggtgtgcggcgcatccgggcgaacgtttcccggtttctgtggcgctgggtgccgatcctgccacgattctcggtgcagtcacccccgttccggatacgctttcagagtatgcgtttgccggattgctgcgcggtaccaagaccgaagtggtgaagtgtatctccaatgaccttgaagtgcccgccagtgcggagattgtgctggaagggtatatcgaacaaggcgaaactgcgccggaagggccgtatggcgaccacaccggttactataacgaagtcgatagttttccggtatttaccgtgacgcatattacccagcgtgaagatgcgatttatcattccacctataccgggcgtccgccagatgaacctgcggtactgggtgtagcactgaacgaagtgttcgtgccgattctgcaaaaacagttcccggaaattgtcgatttttatctgccgccggaaggctgttcttatcgtctggcggtagtgacgatcaaaaaacagtacgccggacacgcgaagcgcgtcatgatgggcgtctggtcgttcttacgccagtttatgtacactaaatttgtgatcgtttgcgatgatgacgtcaacgcccgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggtgaaacccagcgtgaatggggacgtcccatcaaaaaagatccagatgttgtcgcgcatattgacgccatttgggatgaactggctatttttaacaacggtaaaagcgcctgatgcgcgtttgttttgccctatttatcgatccgacagagaaagcgcatgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcttcgacgccagatgaaaaagggtttatcgagctgcatattggcgcttctgaaatcaacctttacgcgaaagcagtcatggaccgcatcctcaaagatcatcaaatcgtggtcgatattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttgaagcatcctggtctacaagtggtgccggtggttgaacaaccggaagcgggctggcgtgggcgtactggcaccgtgttaacggcggtattgcaggatcatggtacgctggcagagcatgatatctatattgccggacgttttgagatggcgaaaattgcccgtgacctgttttgcagtgagcgtaatgcgcgggaagatcgcctgtttggcgatgcgtttgcatttatctgagatataaaaaaacccgcccctgacaggcgggaagaacggcaactaaaactttattcagtggcatttagatctatgtcgcatccggcaattggtgcacgatgcctgatgcgacgctggcgcgtcttatcaggcctacattggtgccggatcggtagaccggataaggcgttcacgccgtatccggcatacagtgcccgatgcgacgctgccgcgtcttatcgggcctacaaaagttctgaaccgtaggccggataaggcgttcacgccgcatccggcaagtggttaaacccgctcaaacaccgttgcaatgccctgacccagaccgatacacatcgtcgccagaccaaactggacgtctttgtgttccatcagattcagcagcgtggtgctgatacgcgcaccggaacaacccagcggatgacccagcgcgatcgcgccaccgttgaggttgatcttctcgtcaatctgctccattagcccgagatctttaatacacggcaggatctgcgcggcaaaggcttcgttcatctcgaatacgccgatatcgctggcagaaagccccgcttttttcagcgccagcttcgaggccggaaccggaccataacccataatagatgggtcacaacccacaaccgccatcgaacgcacgcgggcgcgcggcttaagacctaattcacgggcgcggctttcactcatcaccagcatggcagctgcgccatcggaaagcgcagaagatgtacccgccgttaccgtaccgctgacgggatcaaacgccggacgcagtgtggcgagggcttccacggtggtttccgggcgaatcacttcgtcgtaattaaactgcttcaatacgccgtcggcatcgtgaccaccggtcgggatgatttcatttttaaatgcgcctgactgcgtggcggcccacgcgcgggcgtgtgaccgcgcggcaaaggcatcctgcatttcacggctgataccatgcatacgcgccagcatttctgccgttaagcccatcatgcccgccgctttggcgacattacggctaaggccggggtgaaaatcgacgccgtgactcattggcacatggcccatatgctccacgccgccaaccagacatgcctgcgcatcgccggtcatgatcattcgtgctgcgtcatgcagtgcctgcatggatgaaccacacaagcgattaacggtaaccgccgggacagagtgcggcacttcagccaacagtgccgcgttacgggcgatgttaaaaccctgctccagtgtttgctgcacacaaccccagtaaatatcgtcgagggccgctgcttccagcgccgggttacgcgccagcaggctacgcattaaatgagcggagagatcttccgcacgcacgttacgaaaagcaccgcccttcgaacggcccatcggggtgcgaattgcatcgacaatgacaacctgttccattgtgactccttaagccgttttcaggtcgccaaccggacgggctggctcaaccgggggatagtacggttcgttatgacgtgctttattacgcagaccttccggtacttcatacagcgggccgaggtgctgatattgctgtgccatatcgaggtattttgcgctgccgagggtgtccagccagcggaacgcgccgccgtggaacggagggaagcccaggccgtagaccagcgccatatccgcttctgccggagtggcgataatgccctcttccagacagcggaccacttcgttgaccatcgggatcatcatgcgggcgataatctcttcctcgctgaaatcgcgcttcggctggctcacttttgccagcaggtcgtcaacgacgacatcttcttctttcttcggcttacctttgctgtcttctttataacgccagaaaccgaggccgttcttctgaccaaagcggttggcatcaaacagcgcgtcgatggcatcgcgataatctttctgcatccgctgcgggaagcctgctgccatgacagcctgagcgtgatgcgcggtgtcaatgcccacaacatccagcagatatgccggacccatcggccagccaaactgtttttccatcactttgtcgatcttgcggaaacccgcgccgtcgcgcagcaactggctgaaaccggcgaaataggggaacagcacacggttgacgaagaagccggggcagtcgttgaccacaatcggcgtcttgcccatcttgctcgcccaggcgacgactttcgcgatggtttcgtcggagcttttctcgccgcgaataatttccaccaacggcatccggtgcaccgggttaaagaagtgcatcccgcagaagttttccggacgttccagcgcgttggccagttcgctgataggaatggttgaagtgttagacgccagcacggtatccgggcgtactttctgctcggtttctgccagcacggcttttttcactttcgggttttcaacaaccgcttctaccacaacatccacgcggtcaaacccggcgtagtcgagcgttgggtgaattgtggagatcacgccagccagtttcagaccatcgatcttgccgcgctcaagctgcttgttcagcagtttcgcggcttcggtcatgccgagggttaacgacttgtcgttgatatctttcatgacaaccggcacgcctttccacgcagactggtaggcgatgccgccgcccataatgcctgcgcccagcacagcggcctgtttcggggtttcaacatctttggtgagtttcttcgctttaccttttacatattgatcgttaaggaaaatgccgaccagtgcgcgggcttcgttggtatgcgccagcgggacaaaacttttgttttccaggtttaaggcttcttcacgaccaaaacgggccgcagcttcaatggtttttactgcggtgatgggggccggataatgtttccccgccgtttgcgcgaccatccctttagcgatggtgaagctcatggcggcttcaatcttgctcagttttagcggttccagcttcggctgacgttttgctttccagtcgaggtcgccgttaatggcctggcgtaaaatcgctatcgccccttcaaccagtttttctgctttgactacgccatccaccagaccgattttcagcgcctgatccgcgccgacatctttaccggcggcaatgatttccagcgcactgtcagcgcccagcatacgtggcatacgtacagaaccgccaaagcccggcatgatgcccaatttggtttccggcagaccgatgcgcagatccggcgtcgccagacgataatcggtcgccagcacgcattcgcagccaccgcccagcgcatagccgttgacggcagcaatggtcggcaccggcagatcttccaggcgattaaacacgctattggcaaagtgcagccactgacttaactgttcttcaggaacgaggaacagggacaaaaattcggtgatatcagcaccgacgataaaggctgctttgttcgaacgtagcagcagtccttttagatctgattgctgttccagcacgccgatggcctcgccgaggctggcgacggtcgcagtgtcgagtttattaactgaacctggggtatcaaataccagttcggcaatgccatcttccagccagtcaaggtaaagggtgtcgcctttgtaaagcatgtcagtctcctgaatccgcaaggtgatctggtcgtaccagatgcatcgaagtgtgtattttgtgttaaaaatatgcaaataaaatattaaggaaatgccgatctgatcacgctcggcagaaatcacgctctggatgaacgatgtgctaagatgcggagacttaaggtcaaaaaaacagaagggtaaaaaatggaatcactggcctcgctctataaaaatcatatagctaccttacaggaacggactcgcgatgcgctggcgcgcttcaagctggatgcgttacttattcactccggcgaactgttcaacgtttttctcgacgatcatccctatccgtttaaagtgaacccgcaattcaaagcgtgggtgccggtaactcaggtgccaaactgctggctgctggtggatggcgtgaataagccgaaactgtggttttatctgccggttgattactggcacaacgtcgaaccgctgccgaactccttctggactgaagatgtagaagtgatcgcgctgccaaaagccgatggcattggtagtctgttgcctgctgcgcgcggcaatatcggttatatcggtccggtgccagaacgtgcgctgcaactgggtattgaggccagcaatatcaacccgaaaggggtgatcgactacctgcattactatcgctccttcaaaaccgagtacgaactggcctgtatgcgtgaagcgcagaaaatggcggtcaacggtcatcgcgcggcagaagaagcgttccgttctggcatgagcgagttcgatatcaacattgcctatctgaccgcgaccggtcatcgtgataccgacgtaccttatagcaacattgtggcgcttaacgaacacgctgcggtgttgcattacaccaaactggaccaccaggcaccggaagagatgcgcagcttcctgctggatgccggggccgaatataacggctatgcggctgatctaacccgtacctggtcggcaaaaagcgacaacgactacgcacagctggtgaaagacgtaaatgatgagcaactggcgctgatcgccaccatgaaagcaggcgtcagctatgtggattaccatatccagttccatcagcgcatcgccaaactgctgcgtaaacatcaaatcatcaccgatatgagtgaagaagcgatggtcgaaaacgatctcaccggaccgtttatgccgcacggtatcggccatccgctgggcctgcaggtgcatgacgtagccggttttatgcaggatgatagcggtacgcacctcgcggcaccggcaaaatatccgtacctgcgctgcactcgtattctccagccgggcatggtgttaaccatcgaaccgggtatctacttcatcgaatcgcttctggcaccgtggcgtgaagggcagttcagcaaacacttcaactggcagaaaattgaagcactgaaaccgttcggcggcattcgtatcgaagacaacgtggtgattcacgaaaacaacgtggaaaacatgacccgggatctgaaactggcgtgatggaaagctggttaattcctgcggcaccggtcacggtcgttgaagagatcaaaaagagccgcttcattacgctgttggcgcataccgatggcgttgaggcggcaaaagcgtttgttgaatcggtgcgggcagaacaccccgatgcccggcaccattgcgtggcgtgggtggcgggtgcgccggatgattctcaacagctgggtttctctgacgacggggagccggcgggaacggcaggtaaaccgatgctcgcccaactaatgggcagcggcgtcggggaaattaccgctgtggtggtgcgctactacggcggcatattgcttggcaccggtgggttagtgaaagcgtatggcggcggcgtgaatcaggcgctgcgccagctaacgacccaacgcaagacaccattaaccgaatatactttgcaatgtgaatatagtcagttaaccggcattgaagcgttgctggggcagtgtgacggcaaaattattaacagtgattatcaggcattcgttctgctgcgggtggcgcttccggcggcgaaagtggctgaattttccgcaaagctggcggattttagccgtggttcattgcaattgttagcgattgaagaataatccccacttcgttttgcagaactaaggaagcggcagagatgcattttcgcgccattacccgaatcgttggactactggtcatcttattttcagggaccatgattatccctgggctggtagcactcatctaccgggatggagcgggccgcgcttttacccagaccttttttgtcgccctcgccattggctctatgctttggtggccgaaccgcaaagagaagggcgaactgaaatcccgtgaggggtttctgatagtggtgctgttctggaccgtgctgggtagcgtcggtgcgctcccttttatcttctcggaaagcccgaacctcacgattaccgatgcgttttttgaatctttctctggcctgaccaccacgggggccactacgctggtggggctggattcgctccctcatgccatcctcttttatcgccagatgctgcaatggtttggcggtatggggatcatcgtgctggcggttgcgatactgcctatcctcggcgtgggtgggatgcagctctatcgcgcagaaatgcccggcccgctgaaagataacaaaatgcgcccgcgaattgcggaaacggcgaaaaccctgtggttgatttatgtcttgctgaccgtcgcctgtgcgctggcgttgtggtttgctggaatggatgcctttgatgccatcggccatagctttgcgaccatcgctattggcggcttctcgacacatgatgccagtatcggttatttcgacagcccgactattaacactatcattgctatcttcctgctgatctctggctgtaactacggtctgcacttttcactgttaagtgggcgtagtctgaaggtttattggcgcgatccggaatttcgcatgtttatcggcgtacagttttcactggtggttatttgtacactcgtactgtggtttcataatgtctacagttcggcgctgatgacaattaaccaggcgtttttccaggtggtgtcgatggcgacaaccgccgggtttacaactgacagcattgcccgctggccgctctttttgccggtactgcttttatgttcagcttttatcggcggttgcgccgggtcaacgggcggtggcctgaaagtgatccgcatcctgctgctgtttaagcaggggaaccgtgagctgaaacgactggtgcatccgaacgccgtctatagcattaagctggggaatcgcgcactgccggaacgtatcctcgaagccgtttggggatttttctccgcctatgcattggtgtttattgtcagtatgctggcgattatcgccacgggcgtggatgacttttctgcctttgcctcggttgttgcaacattgaataacctggggccagggcttggcgtggttgctgataactttaccagtatgaacccggtggctaaatggatcctgattgccaacatgctgtttggtcgtctcgaggtctttacattgctggtgctctttaccccgactttctggcgtgaatgatggagtaatacgtgaaaacattaattcttttctcaacaagggacggacaaacgcgcgagattgcctcctacctggcttcggaactgaaagaactggggatccaggcggatgtcgccaatgtgcaccgcattgaagaaccacaatgggaaaactatgaccgtgtggttattggcgcttctattcgctatggtcactaccattctgcgttccaggaatttgtcaaaaagcatgcgacgcggttgaattcgatgccgagtgccttttactccgtaaatctggtggcgcgtaaaccggagaagcgtactccacagaccaacagctacgcgcggaagtttctgatgaactcgcaatggcgtcccgatcgctgtgccgtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataagcataaagaataaaaaatgcgcggtcagaaaattattttaaatttcctcttgtcaggccggaataactccctataatgcgccaccactgacacggaacaacggcaaacacgccgccgggtcagcgggattctnnnnncattccattcattaattaattaatgaatgaatgnnnnngctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccagccgggaactcaaaggagactgccagtgataaactggaggaagggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgtagtgctcacacagattgtctgatgaaaatgagcagtaaaacctctacaggcttgtagctcaggtggttagagcgcacccctgataagggtgaggtcggtggttcaagtccactcaggcctaccaaatttgcatcgcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgcaaaggttcactgcgaagttttgctctttaaaaatctggatcaagctgaaaattgaaacactgaacaacgaaagttgttcgtgagtctctcaaattttcgtaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcggcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgtgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctctttatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggtaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaagattttcagcctgatacagattagattaaccggcgacaagcgggttaatgaaacagaatttgcctggcggccttagcgcggtggtcccacctgaccccatgccgaactcagaagtgaaacgccgtagcgccgatggtagtgtggggtctccccatgcgagagtagggaactgccaggcatcaaattaagcgaaaggccatccgtcaggatggcctttttgcattggagcagaataaatgccggatgcgacgctggcgcgtttgctccagcctactcttgcctatccgtcctgcttttgcatccactccaccacaaaatcagccagcccctcaacatcattaatatccagtaacgcgacatcaagattaagcggcacatcactggctacagcaataacatgcctgtctatcactaattcttccggtcgatgtccggctccatcgcgaaacagcacaatctttgcgatctcttcatgcttaaacccttcgaccagaatcaaatccagctttgaggtatccattcgacttgcgagaaaatgtagatccagctcttcttcgtctggtgtttccgtcatcaaggcccatcgctgttggctggcaacgatggtttgcgccgcgccagccttgcgcagctcatagctatctttgcccggtttatcaacatccatatcatggtgcgtatgcttaatcagccccggacggatccctctggcgcataatgccgggatcaattttttcagcagcgttgtttttccggtgccactccatgcagcaaaggcgagtaacggtatcatcgtttttcctgccatcgggcaagctcctctggcgtattcacgtttataaatgcctctttacgatcgctgaaatcaaccgcatgaccgccagccagacgcataaatgccataacccggcgttctcctgcttgcagatattccagtaataaaggctcaattgcgcggtttaccagagcaatagtcgggtgatcgcgttcaccgtcgtggacccacacgacaggcgcatctttgcgctgatgagtaagccgggcggctaaatcatggggaatgtaaggcgtatcgcacgggcaaaacaaaaaccactcacccgcttcctgctgcattactgaaagcattcctgccagaggaccagggtaatccgccagtgaatcttcaatcactttcagaccgcttacctgatagatttcctgatgacgattagcattaatcacgacgtgagaaagctgcgtcataagcgcgtcagcgacatactgccataatggtttgccgtttaattcaagcaatcctttatctacgccgcccattcgtctggctttaccgcccgccagcacaacgcctgttatcatcgtcatcagattcaccgatatcgcctcttttattgtgggattgaccctgctaacgtgtctgtctcaagagtaaggagcattactatgaaatgtaaacgtctgaatgaagttattgaactcctccagccagcctggcaaaaagagccagaccttaacctgctgcaatttttgcagaaactggcgaaagagtcaggttttgacggcgaactggcggatttgacggatgacattctgatctatcacctgaaaatgcgtgattccgcgaaagatgcggtgatcccgggtttgcagaaagattatgaagaagatttcaaaacggcgctattacgcgcacgtggcgtaattaaagagtaaaagcttgtaagcggcgcaaccaaaatcatcgtgaaatgatatccttcatcattcgtaatgttttccggatgatgggatgaacaacagcgcttttactttccagacactacacccggataccatcatggacgctctgtttgagcatgggattcgggtggattccggtcttaccccgcttaacagctatgaaaaccgtgtctatcaatttcaggacgaagatcgtcgacgttttgtcgtcaaattttatcgccctgaacgttggacagccgatcaaatcctcgaagaacatcaatttgcgttgcagctggttaacgatgaagttccggtcgcagcacctgtggcctttaatggtcagactttattgaaccatcagggattttatttcgctgtttttccaagcgtcggtggtcgccagttcgaagctgataatatcgatcagatggaagcggttgggcgttatttagggcgtatgcaccagacggggcgcaaacagctttttatccatcgcccgaccatcggtttgaatgaatatctcattgagccacgcaagctgtttgaggacgctacactgataccttccgggttgaaagcggcattcctgaaagcgacagatgagctgattgccgccgttacagcacactggcgggaagatttcaccgttctgcggctacatggagactgccacgccgggaatattctctggcgcgatggtccaatgtttgttgatctggatgatgcacgtaatggtccagccgttcaggatttgtggatgttgctcaatggtgataaagccgagcagcggatgcaactggaaactattattgaggcttatgaagaatttagcgagttcgacaccgctgaaatcggactgattgaacctttacgcgccatgcgtttggtttattatcttgcctggctaatgcggcgttgggctgatcccgcgttcccgaaaaatttcccgtggttaaccggggaagattactggctacgacagacggtgacttttatagaacaggcaaaagttctacaagaaccccctttgcaattaacacctatgtattaatcggagagagtagatcatgaaaaagatttggctggcgctggctggtttagttttagcgtttagcgcatcggcggcgcagtatgaagatggtaaacagtacactaccctggaaaaaccagttgctggcgcgccgcaagtgctggagtttttctctttcttctgcccgcactgctatcagtttgaagaagttctgcatatttctgataacgtgaagaaaaaactgccggaaggcgtgaagatgactaaataccacgtcaacttcatggggggtgacctgggcaaagagctgactcaggcatgggctgtggcgatggcgctgggcgtggaagacaaagtcacagttccgctgtttgaaggcgtacaaaaaacccagaccattcgttcagcatctgatatccgcgatgtatttatcaacgcaggtattaaaggtgaagagtacgacgcggcgtggaacagcttcgtggtgaaatctctggtcgctcagcaggaaaaagctgcagctgacgtgcaattgcgtggtgttccggcgatgtttgttaacggtaaatatcagctgaatccgcagggtatggataccagcaatatggatgtttttgttcagcagtatgctgatactgtgaaatatctgtccgagaaaaaataattcaatgtaaattacataaagcccgtgaatattcacgggctttttttattatttaataaatataaatacattctgataatgcttcctgctgctggacattatttcagcataagtggatattcaaagttttgctgttttatcagggaatatttatatgatacgtaagtcagctacaggtgccattgttgcgttagccgtaatctggggtggtggcacatggtacacaggtacgcaaattcagcctggtgtcgaaaagtttattaaaggttttaacgatgctaaaaagaaaggtgaacatgcctacgatatgacgttaagttataaaaattttgacaaaggcttttttaattcccgttttcaaatgcaaatgacatttgataacggtgcacccgatctcaatatcaagccaggccagaaaattgtatttgatgtggatgttgagcacggtccgttgcccatcacaatgttaatgcatggtaatgtcatcccagcactggcagcggcaaaagtgaacttagtgaataatgagctgacacaaccgctatttatcgccgcgaaaaataaatcgcccgtggaagcgacattgcgattcgcgtttggtggcccattctccacgacattagatgttgcccctgcagagtatggaaagttttcttttggtgaaggccagtttacttttaatggtgatgatagttcattgtctaacctggatattgaaggcaaagtcgaagatattgttctgcaattttcaccaatgaacaaagtaacggcgaaaagttttaccattgattctctgacacgattagaagaaaagaaatttccggttggtgaaagcgagtcgaaatttaatcaggttaatattatcaaccagggggaagtcgttgcccaaatcgatgctttcgttgcaaaaaccaggctggatcgcgttaaagacaaagattatatcaatgtcaatctgacctacgaacttgataagttaacaaaagggaatcagcaactcggtagtggtgagtggtcattgattgctgaatctattgatccctcagcggtgcgccaatttatcatccagtataacattgcgatgcagaagcagcttgctgcacaccctgagttagcaaacgatgaagttgctctgcaagaagtgaatgctgcattgttcaaagagtatttaccgttattacaaaaaagtgagccgacgattaaacaaccagtaagatggaagaacgcactcggcgaactaaatgccaatctggatatcagtattgccgacccagccaaatcttcatcatccacaaacaaagatattaaatcgctcaattttgatatgaagttaccgcttaatgtcgctacagaaaccgcaaaacagcttaatttatctgaagggatggatgcggaaaaagcgcaaaagcgggctgataagcaaatcagtgggatgatgacattaggtctgatgttacagttaatcacgattgacaacaataccgcctcgctgcaactgcgttatacaccgggtaaagttgtttttaacggacaggagatgagcgaagaagaatttatgtctcgtgccggacgttttgttcattaaaatactcactcgcctctgctcattcagaggcgagtaaaacttacttttcctgccgctgtgatgacatcaacgatgtcagaagccggtctttttcctgccacaatgagttcagccattgctgaaaatggcgcttaaagcttttgtcattgatgtagtcgccatgtaactcatcggcaataggctgtaaatccacatgtacgacaattcgcgtcagtttaccgcttaacatatcgaagaacggctgacggttattgtccggataacacagcgtaacattaagcagtttatcgaattgtttacccagtacatttagcgccatcgcaatgcctgccgcctttggtggcaacaagttttgaaaagaggagtgggtttgctgatgtttttcttgcgtgaaacgggagccttcaacgaaattgacaatagtggtggggtgcaggcgaaacttttcacaagaacgccgagtggtttcaacatctttaccacgtcgctccggatgacgtaataaataagcgcgggaataacgcttcataaacggcatatccagcgcccagcacgccaggccaagaaaaggcacccaggccagctgctgcttgaggaaatatttattcatcggaatgtgcttacgaaacagcacgcacagtacgacaatatctgcccaactacggtggttacaaataagcagataccagttcttcttacttaacccttccagcccgtgaacttcccattgcaggtgtgggttcagatgcagtaataccgccagaccttcacaccagcaatacatcataaaatcacaaaaacgcgaaacctttcgccaaatgactggcacaggtagcaatagttttacaatcccggcaatgatgatcgggacggaacaaaaaatagtgaccaaaatggtcaatacgatactcagcaaaagggttatcgcagcgagtattctcgtcataatgaatttattcaaaaggttagccatagacagtgcgctaaagaagcgcaaggcgcagattttagcagaaaacgacccaaataacggatgatccttaaggagaaaaataattcatatctatccacattagaaaaaatcccattatctcaattattagggatggctttatttttaactgcatgaaaaacaaagacaaacaccatgctgtaaaaagcatgataataaattaaaagcgatgtaaataatttatgcacaaagttatccacatgacgatttgcgagcgatccagaagatctacaaaagattttcacgaaaagcggtgaaaaactcatgttttcatcctgtctgtggcatcctttacccataatctgataaacaggcacggacattatggttcagatcccccaaaatccacttatccttgtagatggttcatcttatctttatcgcgcatatcacgcgtttcccccgctgactaacagcgcaggcgagccgaccggtgcgatgtatggtgtcctcaacatgctgcgcagtctgatcatgcaatataaaccgacgcatgcagcggtggtctttgacgccaagggaaaaacctttcgtgatgaactgtttgaacattacaaatcacatcgcccgccaatgccggacgatctgcgagcacaaatcgaacctctgcacgcgatggttaaagcgatgggactgccgctgctggcggtttctggcgtagaagcggacgacgttattggtactctggcgcgcgaagccgaaaaaaccgggcgtccggtgctgatcagcactggcgataaagatatggcgcagctggtgacaccaaatatcacgcttatcaacaccatgacgaataccatcctcggaccggaagaggtggtgaataagtacggcgtgccgccagaactgatcatcgatttcttggcgctgatgggtgactcctctgataacattcctggcgtaccgggcgtcggtgaaaaaaccgcgcaggcattgctgcaaggtcttggcgggctggatacgctgtatgccgagccagaaaaaattgctgggttgagcttccgtggcgcgaaaacaatggcagcgaagctcgagcaaaacaaagaagttgcttatctctcataccagctggcgacgattaaaaccgacgttgaactggagctgacctgtgaacaactggaagtgcagccaccggcggcggaagagttgttagggctgttcaaaaagtatgagttcaaacgctggactgctgatgtcgaagcgggcaaatggctacaggctaaaggggcgaaacccgcagccaggccgcaggaaaccagtgttgcagacgaagcgccagaagtgacggcaacggtgatttcttatgacaactacgtcactatccttgatgaagaaacactgaaagagtggattgcgaagctggaaaaagcgccggtatttgcatttgataccgaaacagacagccttgataacatctctgctaacctggtcgggctttcttttgctatcgagccaggcgtagcggcatatattccggttgctcatgattatcttgatgcgcccgatcaaatctctcgcgagcgtgcactcgagttgctaaaaccgctgctggaagatgaaaaggcgctgaaggtcgggcaaaacctgaaatacgatcgcggtattctggcgaactacggcattgaactacgtgggattgcgtttgataccatgctggagtcctacattctcaatagcgttgccggacgtcacgatatggacagcctcgcggaacgttggttgaagcacaaaaccatcacttttgaagagattgcgggtaaaggcaaaaatcaactgacctttaaccagattgccctcgaagaggccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgaagctgaaatcgacctacaccgacaagctgccgttgatgatcaacccgaaaaccgggcgtgtacatacctcttatcaccaggcagtaaccgcaacgggacgtttatcgtcaaccgatcctaacctgcaaaacattccggtgcgtaacgaagaaggtcgccgtatccgccaggcgtttattgcgccagaggattatgtgattgtctcagcggactactcgcagattgaactgcgcattatggcgcatctctcgcgtgacaaaggcttgctgaccgcattcgccgaaggaaaagatatccaccgtgcaacggcggcagaagtgtttggtttgccactggaaaccgtcaccagcgagcaacgtcgtagcgcgaaagcgatcaactttggtctgatttatggcatgagtgctttcggtctggcgcggcaattgaacattccgcgtaaagaagcgcagaagtacatggacctttacttcgaacgctaccctggcgtgctggagtatatggaacgcacccgtgctcaggcgaaagagcagggctacgttgaaacgctggacggacgccgtctgtatctgccggatatcaaatccagcaatggtgctcgtcgtgcagcggctgaacgtgcagccattaacgcgccaatgcagggaaccgccgccgacattatcaaacgggcgatgattgccgttgatgcgtggctacaggctgagcaaccgcgtgtgcgtatgatcatgcaggtacacgatgaactggtatttgaagtccataaagatgatgtcgatgccgtcgcgaagcagattcatcaactgatggaaaactgtacccgtctggatgtgccgttgctggtggaagtggggcgtggcgaaaactgggatcaggcgcactaagattcgcctgaacatgcccttttttcgtaagtaagcaacataagctgtcacgttttgtgatggctattagaaattcctatgcaacaactgaaaaaaaattacaaaaaatgctttctgaactgaacaaaaaagagtaaagttagtcgcgtagggtacagaggtaagatgttctatctttcagaccttttacttcacgtaatcggatttggctgaatattttagccgccccagtcagtaatgactggggcgttttttattgggcgaaagaaaagatccgtaatgcctgatacgccatgtttatcaggccaacggtagaattgtaatctattgaatttacgggccggatacgccacatccggcacaagcattaaggcaagaaaattattcgccgtcctgcgtttcttctacaggctgcatctcgctaaaccaggtatccagtttctgccgcagcttgtccacgccttgtttcttcagcgaagaaaacgtttcaacctgcacatcaccgttaaacgccagcaccgcttcacgcaccatattcaattgcgctttacgtgcgccgcttgccagtttgtccgctttggtcagcagtaccagcacggcgatattgctgtctaccgcccactcaatcatctgctgatccaaatctttcagcggatggcgaatatccattagcaccaccagaccttgcaggctctgacgtttttcgaggtactcgccgagcgcgcgctgccatttgcgcttcatctcttccgggacttccgcataaccgtacccaggcaagtcaaccagacgcttgccgtcagccacttcaaacaggttgataagctgggtgcgccccggggtttttgaggtacgagccaggcttttctggttagtcagcgtgttcagcgcgctggatttacctgcgttggaacggcctgcaaaagccacttcaattccggtatcggaaggtaggtggcgaatatcaggcgcactcatcacaaaatgcgtctgttgataattcaaattagtcaaagcggtcgtctccatcagtcaaagctttgcggcgattatacctgaaccataataaaaggcggatttttcggcgtgagcgttgtaagtaaaagccatatgctttgtgagacattgccgatagtctttatgcgaaatagcagagaaaattctgcgacgcatgtcaaataagctatataaatcagtgaattgcttttatataaaactctgaaaatgtgcaaatactgatggcggttgattgtttatttaaagcaaaggcgtaaagtagcacccatagagcgaggacgctaacaggaacaatgactcaggatgagggtcaggagcgccaggaggcgaagacagaggattgtcaggaagataaacgtccggagacgtaattaaatggaaatggaatcaacacggattgttccggctaatggaaaaacagggtgtgttggcggcctgcaaggattgtaagacccgttaagggttatgagtcaggaaaaaaggcgacagagtaatctgtcgccttttttctttgcttgctttctgttagattccgccgcaaatctatactgaataaaacggctaaaagacgaaccattatgaaaccatcatcttcaaactcacgcagcaaaggtcatgcaaaagcgcgtcgaaaaacacgcgaggagctggatcaggaagctcgtgaccgtaagcgtcagaaaaaacgtcgtggtcatgcgccgggcagccgcgcagcgggcggtaacaccacgtcaggcagcaaaggccagaacgcaccaaaagatccacgtattggcagtaaaacccctattccattgggcgtggctgaaaaagtcaccaaacagcacaaaccgaagagtgagaaacctatgctttcaccgcaggcggagttggagttactggaaacggatgagcgtctggatgcgctgctggaacgtctggaagcaggcgaaaccctgagcgccgaagagcaatcctgggtggatgtcaaactggatcgtattgatgagttgatgcagaaactcggcctctcttatgacgatgacgaagaagaggaagaagacgagaagcaagaagacatgatgcgtctgctgcggggcaactaacggattgccgccgtgggtcttcccgttctgctgataacccttccggttatatgttatctggtgtggttattcgttaaactacagcggttgtcgcggcgacaaaagtggctgcgcaaccggctgatgactcgaaacgggcatccgccggtacgccgtagccgccagagacgccatcggaaggagtgagcatgtctgtacagcaaatcgactgggatctggccctgatccagaaatataactattccgggccacgatacacctcgtacccgaccgcgctggagttttcagaagacttcggcgaacaggcgtttttacaagccgtggcgcgctatcctgagcgtccattatctctctacgtacatattccgttctgccataagctttgttacttctgcggttgcaataagattgttactcgccagcagcacaaggccgatcagtatctggacgcgctggagcaagaaatcgtccatcgtgcaccgctgttcgccgggcgtcacgtcagccaattgcactggggcggcggaacgccgacgtatctgaataaagcgcaaatcagccgtctgatgaagctgctgcgcgaaaacttccagttcaatgccgatgcggagatctcgatcgaagtcgatccgcgggaaatcgaactggatgtactcgatcatttacgcgccgaaggctttaatcggctgagcatgggcgtgcaggacttcaacaaagaagtgcaacgtctggttaaccgcgagcaggatgaagagttcatctttgcactgcttaaccatgcgcgtgagattggctttacctccaccaacatcgacctgatttacggcctgccgaaacagacgccggagagtttcgcctttaccctgaagcgtgtggcggaactgaaccctgaccgtctgagcgtctttaactacgcgcatctgccaactatttttgccgcccagcgcaaaatcaaagatgctgacttgccgagtccgcaacaaaaactcgatattctgcaggaaaccatcgccttcctgacacaatcgggctatcagtttatcggtatggatcactttgctcgcccggatgacgagctggcggtggcccagcgtgaaggcgtgctgcatcgtaacttccagggctacaccactcagggcgataccgatctgctggggatgggcgtttccgccatcagcatgattggcgactgctacgcgcagaaccagaaagagttgaagcagtactatcagcaagtggatgaacaaggcaatgcgctgtggcgtggtattgcgctaacgcgtgatgactgtattcgccgcgatgtgattaagtcgctcatctgcaacttccgtctggattacgcccctattgagcaacagtgggatttgctcttcgctgattactttgcggaagatctcaagctgctcgccccgttagcaaaagatgggctggtggatgtggatgagaagggaatacaggtgacggcgaaaggtcgcttgctgatccgcaacatttgcatgtgctttgatacctatctgcgccagaaagcgcggatgcagcagttctctcgggtgatttaaattgtgaatggcgcttcgtttacaaagtagaaaacgaaagcgccatcaatgtgctgagaacaagattgcctgatgcgacgctggttgcgtcttatcaggcctacgactttctccgcatccggcgtaaacaacgagcttcagctaaacagccctatcatcgcggcacacagcacggcagcaacagcagtttgcggtgtgtggctgtcaactgcgccactcgataccagattaattattgattccagcataatgactctccccgttttccgggcaagatcatactgaacttatcggaacagtaaagcgcaaaataccagcaatttgcgctcaataatcaatctttacacacaagccgtgaatcactccatccccagctcttttaacttacgcgtcagggtgttgcggccccagccaagtagccgcgccgcttcctgtttatgcccctgcgtatgtcgcagcgcggtggtcagtaacgtccgttccagctctggctgtgcttcggaaagcaggttttgatgaccggaacgcagcgctctgtctgcccactgtgctaacagcgttgcccaactgtccggctgcatgtgtgaagtgctttccggtacgtttgattcaaacagttcgccaggcaaatcctgaatcaacacttcctgtccggcagccatcaccgttagccagcgacaggtgttttccagctggcgcacgttgcctggccacgccagacgcgtcagcgcggcttcggtttccggatgcagcaacttcgcttctacgcccagctctcgcgcggcaacctgtaaaaaatggcgtgccagacggggaatatcttcccgacgttcgcgcagtggcggcagatgaacgcggatgacgttcaggcggtggaacagatcctcacggaacttgccttcctgcacccgctgttcaagattctggtgagtggcagcgataatccgcacatccactttcaccggcgcatagccgccaacgcgataaaactgaccatctgccagcacgcgcagcaaacgcgtctgcacatccagcggcatatcgccaatttcatcgagaaataatgtaccgccatcagcttgttcaaaacgcccctgacgaatggtattcgcgccggtaaatgcgcctttctcgtgaccaaacagttcggattcgatcaaatccttcgggatagccgccatattcagcgcgataaatggcgctttggctcgcggactgtggcgatgaagggcatgagcgaccagttctttaccggtgccggactcgccgttaatcagcacgctaatagaagaacgcgaaagccgaccgataatccggaacacgtcctgcatggctggcgcttcaccgatgatatcggtcgttgggccgttaagctgaacattacgcggctgctgctgttcctggtaatgactgatggcgcgctcaaccagcgccacggcttcgtcgatatcaaacggtttgggcagataatcaaatgccccttgttgataggcgctgacggcagcatccagatcggaatgtgcggtcataatgatgaccggaagcatcggatggcgctgtttaatctgcttgagcagcgccagcccgtccattcccggcatacggatatctgaaagcagcacatccggcgttttgctcgccagcgcctccagtacttccgcgccgttctcaaatgtcgtacaggttaaacccgctccagcgagcgcacgttcaagcacccaacggatggaactatcgtcatcgactacccagactatccctcgttgcataaacgtcacctttatttcctgataggcaggtaaaccgagaactcggtatgacctggccaactggtaaattcaattttgcctgaatgctgatcaatcaaattacgggcgatggataagccaagcccggtgccaccttcgcggccgctgaccatcgggtaaaacagcgtatcctgcaaatgaggcggaatgcccggcccgttatcttccacatcaatccgcgccgccagccgatagcgctcgccgtgtaaggtcagttgaaacgctgtgcgggtacgcagaatgatttcaccaccctccggccccagcgcctgtagcgcattgcgcacaatattcagcaagacctgttcaatttgatccgggtcgtgcgccagttccggcaggctggggtcgtaatcccgaatcaaccgcacgttgttcggcagttccatcgacaccagcgtcaccacgcgttcagccactttgtgaatactttcggtaatacgcgtaccgggcagctgcggccccaacagacggtcgaccagatttcgcagccggtccgcctgttcgataatcactttggtatattcgagtagtgacgggtcaggtaatgccttgctgagtagctgcgccgcgccacgtaaaccgccaagcggatttttaatctcatgcgccaggccgcgcactaaatcacgggcagcaacctgctgggcgtgctgtagctgttcctgacttaagcggcgctggttatccatcggtgccatctccagcaggatcatgccgtccggcatacgctgagccgtcacagaaaggatatgcgagcgcccgtcgatgaccagcgtcacttcgttatcggtaaaaccttgccccgcctccagactttcttgcatcagctcgatatttaatgagaagtagctcaacagttccggtaacggcgtaccaaacaatttgcgggagctttgggcgagcagttgttgcgcggcggggttggcgtaatggatcgccagattgtcatcgattaacaaaatactgttaatcagcgagttgaggatctgcccagcatcgggctgcgtgcctgttgccataaagcagtctcctgaacaggttgcaccattttagtgcattatagctttttacggataaaaagcgcgaagcatcagagaattgacggagaaaaaagcccatgcagagatgggctgaaagtttccacggcaactaaatcccggcgttgttgcgccgggtagtacaacttcaactattagacgctgtagtacagctcaaactctaccggatgcggagtcatacgcacgcggtcatcttcttcgcgacgcagagcgatgtacgcatcgatcgcttcatccgtgaacacgccaccagctttcaggaactcgcggtccagatccagttcgttcagtgcttcttccagagagcctgcaacctgtgggatctctttcgcttcttctggcggcaggtcatacaggtttttgtccatggcttcgcccggatggatcttgttcttgatgccatcaagaccggccatcagcagggcagcaaagcacaggtacgggttagccgccgggtccgggaaacgtacttcgatacgacgtgctttcggagaagaaaccaccggaatacggatagacgcagaacggttacgcgcagagtaagccagcatcaccggtgcttcgtagcccgggaccagacgcttgtaagagttggtggtcgggtttgccagggcgttaatcgctttcgcgtgtttgattacgccgccaatgtagtacagcgcctgttcagacagacctgcgtatttgtcgccagcaaacaggttaacgccgtttttagacagcgacatgtggcagtgcataccggaaccgttatcaccgaacatcggttttggcataaaggtcgcggtcttaccgaaacggtgcgccacgttgtgcacgacatatttgtagatctgaatttcgtcagcttttttggtcatggtattgaagcgggtagccacttcgttctgacctgcggtagcgacttcgtggtgatgagcttcaactaccagacccatctgttccatcaccagacacatttcagaacgaatatcctgagctgagtctaccggcggaaccgggaagtaaccgcctttcactgccggacggtgacctttgttaccaccttcatattgggtggaggaattccatgcaccttcgatatcgtcgatagcaacgtgggaaccggagatagacgatccgaaacggatgtcatcgaacaggaagaattcaggttctggcccgaacagtacggtgtcggcaatgccagtggaacgcaggtaatcttcagcgcgcttcgcaatagagcgcgggtcacggtcatagccttgcagggtgccaggttcaaggatgtcgcaacggataatcagggtagaatcggcgaagaacggatcaatcactgcggtggatgcgtctggcatcagcaccatatcggattcgttaatgcctttccagccgccaatcgaggagccgtcaaacattttgccttcttcgaagaattcggcattcacctgatgagcagggatagtgacgtgctgttctttacctttggtatcggtgaagcgcaaatcaacaaacttcacttcgtgctcgttcagcatcgtcagtacgtgttcagcggacatactttaactctcctggattggtcattgtcgtcgtggtaacgaaatctgcaattaaatgggccgtgtcgccgtaaaaaagataaagcgaaatctgtgccaacttttaaattgcccctaaaaggcgttatcatgcttaacatcgtgcaaaagggctgcaccatgatgtgaatgttgcaccaatatagtgcttcaatgggaacattaagcaccatattggtgcaatgacctttggataaccctttttatgctccgtgaaagcgatcacaaagggactctgcaatacttgtttgcggaggatgtttgtgatcctgttttgtagtgcgattaatccgtgtacaataacgcgctatttctaatgcctgaggcaaagttgtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtaccaggcgattgttgaccacgttcctgcgccggacgttgaccttgacggtccgttccagatgcagatttctcagctcgattacaacagctatgttggcgttatcggcattggccgcatcaagcgcggtaaagtgaagccgaaccagcaggttactatcatcgatagcgaaggcaaaacccgcaacgcgaaagtcggtaaagtgctgggccacctcggtctggaacgtatcgaaaccgatctggcggaagctggcgatatcgtggcgatcacgggcctgggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtacgggtctgctgtactccaccttcagccactacgacgacgtacgtccgggtgaagtgggtcagcgtcagaacggtgtactgatctctaacggtcagggtaaagcggttgcgttcgcgctgttcggtctgcaggaccgtggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgactccaacctctatccgtattcgtaaacgtcacctgacggaaaacgatcgtcgtcgcgctaaccgcgcaccgaaagacgattaatttcgttttttagttataaaaaacctgccatcgctggcaggttttttttggcttatggaaaacaaaatccgctgaaattcccagcggattttccgaagtttcaatttcaggatacttcttgctcggcaaccaccagttcaacattctcttcacttaacaactggcagaaagaattgggaggcggggcatcagtaaaaaaagccctgacattccgtgcattgccaattgaaacggcagcagacgcggcaaacttcgtatgatcggccactaacaatgtattccgcgcatgtttaatcatcgttctcgcgactaacgcttcattgacatcaaattccagcagggtgccgtcatgctcaatggcacctatactggtgattaaataatctgcgcggaagccttcaataaaatccacggctcctgggccgataatcccaccgttatgagcgcgtaaagtgcctcccggcaccatcacttcaatatcctgattcttataaagaatctgtgccacacgcaggctattagtgataatgcgtaaatcacgccggttgagtaatgccctggcaacggcttctacggttgtaccgatggtgataaagacggtacagcgttcgggaaggtaatcggcgactgcctcagcgatcgcccgtttctcggcggtgagcgaaagttcccgttgctcaaaagcggtattcatgacgctggagacgcgcccggcccctccatgatgacgggtgatcaagccctgctcactgagttttcggatatcccggcgcacggtttgcgttgaaacatccagcagttgtgccagttcttcaatattcatataaccgcgttctgcgattagatgaacgagttggtcatggcgtggattacctgtcacttcgatgatactcatgaatactcccttgcccctcctcggtagatgtttaccattttacgcataaagtgacaaaaatgattcggtttgctcacgattaggaatgccggcccgaccgccaggctgggtacatttcatcgcggcaaccgcactggcaaaacgaatagcctcttttgttggcattttttctgccaacgctaccgcgagtgcgccgtgaaaaacatcgcctgctccagtggtatcaaccacattgacagaaaatgcctcctgttgacacaaatgaccatcttcaatccacaacgatccttcagaacccagcgtaacatacactttacctgctgtttgtgtcgttgcctggaacaaaccttcttcaggtgactgcaggccagtcatgcgtttcagccctggtgttgagaacacggcgtgatcggcaagcgcgacaagtggagaaatatcctgcggtgtcatatcggcgtctaaaagcgttgtcacacccgcaaggcgcgctagcgagaatgctttttcagtaccgctatgccagcgaacatcggccagaatcagatcataacgagagaaatcgatcgcttctaaccattcggcatcagtaccgagatcaggacttggataattaacgataatccgttcgccatgctgatcaacgaggatcgctgattgcgacgaacgggcgtgaggatatcggcggcaaaatgcggtattgacgccccaaccctcaagttctgcaagtaaggtatttccacaactgtcatcgccgacgcgaccgatgaaatcaacctccacgccaagctttgcgattgcaacagcggctgttgctgccgggccgccaccaatctcaagataatgatttgcctgatatttcccgccaccctccggcagagtgggcaaagaataaattctgtcctgaactgtgatacccacgcatgcaattctggtcatatttgtcttgtcctgtttaattttgtcgtctttggtcaatttaaatgacacaaatgatcaaattagtgatgtgtgtcgtgtttttgaacataaattacaaatatgctcaaaaacagacgaaaacgaattttaaattgtcattatttgtcaatgtcagacaggagagtattcatggcaaccattgcatttctcgggctggggcagatgggtagcccaatggctaacaatctattgcaaaaagggcattcattacaggtatttgatgtcaatacacaggccgtcgatgcgctagttacgcagggggccactgcggcacaaaccccagcggaagcggcagcaagcgctgaatttatcatcactatgcttcccaatggggacattgttcgacaggtgctgttgggggaaaaaggcgtctgtgaaactgtttcatctgacgcgttagtgattgatatgtcgactattcatcccttacagaccgatgcattaatacgggaattacaagaaaaaggcatcaatatgatggacgcccccgtgggcagaacgtcagtgaatgcgattgatggcacattgctgattttagcgggcggcactgatgagcagattgcgcgtgcacgcccgattctcatgtgcatgggtaatgagctggtcgaggctggtggcccaggaatggggatccgcgtgaagctaattaacaactatatgagcattgcgcttaatgcgctgtcctccgaagccgctgtgttatgtgagtcactgggattaaatcttgatgtcgcaattaaggtgatgagtggtacggcagcagggaaaggacattttacgaccacctggcctggcaaagtgctgaaaggcgatctttctcccgccttcatggtggacctggcattgaaagatctgcgtattgcagttgacgtcgctcggaaaacgggggcgccgctcaatatggggattgcagcagaaagttattacgccgcagcaagtcaagacggcaaagggcggcaggactggagcgccctgctaaatcaggttcgccagcaggctggtctttaattttatctattaacaggagtttctatgtcatcccacttcaccccatttacgctgaaagatatctcccgcccaggtggtggattcgccatgttagctgtcgatcagcgtgaggccatgcgcctgatgtttgcggcagcagggcagccaaaacccatcgccgacagtgtactcaccgattttaaagttgccgcgacccgaatcctttctccttatgcttctgccgttctggcggataaacaattttgtcttgaacaaatagtcgagcagggcgctgtggctaattcttgcggcctgattgtcgctgccgatctttttatcccaggtaatggcatcccggttgatagcgttgaaatagatatgtccgtcgacccgcataaagcccgtgaaatgggggctaaggcaatgaaattacttgtactctggcgtgaagatgaacccgcagaggaacgtctggcaatggttgataaatttgttcgtcgctgccgtagtgccgggctggttagcattattgaacctgtggtgcgtccacctcgtcgcggttgggactttgatcgtgaaagcgccattgttgccgccgccgcagagcttggtggaacagaggctgatctttacaaagccgagatgccattagggggcaaaggcgatgaaaaaaccttacttgctgcctgtcagcaacttaacgatcagatgaagatgccgtgggtaattctttcttctggcgttgatgccgatatttttggccgtgcagtaagtattgccatgaaaggtggtgcgtcgggcttcctggctggacgagcggtttgggcgtcggttgttggtgcacaagatccacaaaccatgctgcgcgatgtctccgttccacgcttgcaacggctggctgaaattgtcgatgaaggtatcgcgcaacgctaatcccctatggatatcgattctggagaataacaatggataaaattacccaggttttattttcagatattgggaaagtcaccactcaatatgttgaagtaccacaccagcaacttaaaccgcacgaagtacggattgcgcccgtgttctacgggatatgcggttcggatctgcatgttctgaaaggcggtcatccgtttgccaaaccgcctgtcgtccccggtcatgaaattgcagcgcgcgttacggaagtgggcagcgacgttaaaaatgtacagccgggtgatcatgttgtggtcgatcccatcatggcttgcatggaatgccgagcctgcaaagcaggacgttttaatctttgtgaaccaccgcaggttgctggttttcgcgcaccgggctttgctcgctcacaacacattgttcctgcgcgtaattgccatgtcgcaccagcctctttaccgctaaaagtgttggcctttgccgaaccggcggcttgtgctcgtcactgcgttaaccgaatgccgaaagcttctctggaaagcgtactggtgattggtgccggaacgataggcttatccatcgtgcaggcactgcgcattatgggggcaggtaagattaccgtgattgaacctgacgctgccaaacgcgcgctggcgttaaaactgggcgcagcagaagtttgggcaccaggtgagctggccgcagatgtgcgatttacgggggcgattgatgtcgttgcagcgcaggccacgcttaacgatgcatgtacccgtgtatatgccggaggcaccgtcgtgtgcatgggcgtaccaagtgggccgcgtgaaataccattaccgatgatgcaacgtttcgagcgtgacttgctcaactctggcatgtacatccctgaagatttcgatgctgttatcgaatggctggcggatgggcggtttgataccagtgaactggttaccgatttatttgccattgaggatgcagcggcggcattcgaacgcgcgcagcaaaatgactccataaaggtcatgctgcaatttgcgccggaatgattttctaaatctctgtctggcgctgcgtcacgccagcgccaccctacaacaattaaaaaggacactgcgatgagtcaaatcaccagtcctgcaacttattcaattagtcggccacaggacgtaattgatattgttaataagaactctgcaatcaacaccagtatcggcgttatttttattgctttgggcggcatattgattgatgcctaccaggcggcgatggtggggtttggtaataaatacattgccgctcaattcggcatttcgccgggtcttgctgcaaccgtcaatgcatcagtattaatcgccgcgttaattggcggtttattagcgaaccgagtaataaaccgctttgggcaaaagcgggcatttattattggcatggggctgtgcaccatcggtgctgcagcggtagctattgctcccagtatctggtgggtgctggtgtgccgcgtcatcatgggctttggtttaggcatcgacttccctttggcaaccaatgccgtggcagagcttcgtggttcaacgtcgaagaaaaccggcacgtcggtcaacctctggcaaatggcctggtatgtttcgacaaccgttgtttatttggtgcttttgccgctgcttctgtctggtatcgctgaagaacaattgtggcgttacggaatattcatcggagctatttttgcagtcatcttcatgattttgcgttacttctttattggtgaatccgcaatgtgggccgcacgcgtcgggcgttaccaggaagcgtgcgacattctgggaaaacgttatggtgttcaggctcacgttgcggcatcgggtacaacagaagcgaaattctcggaaaaagcagagaataaatacagtggtggatatggcatcttatttaatgatcgttaccgcaaacgcaccattcttggctgtgtcgtggcaaccatgcaggcgtggcaatataacgccgtaggtgtttatcttcctcttacgttggcgggaataataagtggcgggcttactggcgcgttaaccggttctgccgtcgtgaatgccctttgtggggtgacaggcgggatgatcggctcgtttattctccaacgactgggtactcgccgacagtcgatgtatggatttgctgttgtgaccttagcattgctgtcgttaggcgcactggcaacgactaatccctggctgtctttagggttattgggatcaattattttcttccattcagcgggtcctggtgggctgggcatgaccattgccacactctcttatcctcccgctattcgccctactggggtcggatttgcccgcgctattatgcgcacaggggcaattgcaggactcattttctggccgatgctgtggggtgcgttgaaaactgaagcgttttactggttggcaatcgtgccattcctgggattcctgacctgtgtattgattaattgggaaccactgggtgcaaatgttgatgctgaggacgcagaggttctggctgaattgaagaaataatttaatgcgcatcggtttaagccgatgcgcattaattcaaactgcccacgtttagtggttcgtatcccagatttctcgcctaccaggagaggaaaattatgtctgaaaagttacccgcaccgcgtgaagggctttccggtaaagccatgagacgtgtcgttatgggcagtttcgcaggcgcgttaatggaatggtatgacttctttatttttggcacggcagcaggactggtatttgcaccgctgttttatccagacagcgatccttttataggtcttatagcttcctttgcgacctttggtgttggttttctgactcgtcctttaggtggcatcgtctttggtcattttggcgataaaatcgggcgaaaaataacacttatctggacgctggctattgtcggttgctccacatttttgattggttttattccgacgtatcaggaaattggcatttgggcaccgcttgtattaatggtgctgcgtttgattcagggctttggtcttggtggcgagtacggcggagcggcattgatgaccatagaatcagcgcccgaatcccgacgcggatttttaggttcactcccgcaaacggctgcgtctgtgggtattatgctggcaaccggtatttttgctctctgtaaccattttcttacttcggagcagtttctctcctggggatggcgcattccgttttggctttctgcggtgatgttgatcgttgggctgtttatccgcctgcataccgaagaaacgctggattttcaaaagcaaaaaacgacgaataataaagaaaagtccgttcctccgttgattgaattattcaaaaaacatccacgaaatattttattggcactgggtgcgaggctggcggaaagtgtctcctctaatattattaacgcctttggtattgtctatatttccagccaattagcattgtcgcgagatattcccctgacgggtatgttgattgcctcggcgatcggtattttcagttgtccattggttggatggttatcagatcgtataggtcaaaaaagtctgtatttgtcgggagcaggattttgtgtcctgttcgcgtttcctttcttcttattactggatagcaaaagtacgctcatcatctggtgcagtatgatccttggctacaacttaggtccgacgatgatgtttgccgtgcagccaacacttttcacccgcatgttcggtaccaaagtacgatataccggcctttcttttgcttatcaattttccgcgattcttggcggactaagcccccttatcgcctcaagtttgctggcgctagggggaggaaaaccgtggtatgtcgctctgtttttatttgctgtctcagttctttcctttgtttgcgtctggctgattgagccaaccgatgaacaagaaaccgcttcttaccgctacatcagggaacaatctcatgaaaactgaacgaaaaaacgagcattacctggcgctacaacaggcgtttgacgcgccatggcctgggcctgtaggagagttagtgacgctggaaaaaggcaatattcacctgcagatttatccgcatgatggtgccaggataacctcgttaaaggcatttggttctgaagtattacgccaatggcagccgcagcgcagagcttttcagtatggctgtttcccaatggtgccgtgggcagggcgactggggaatgcgacgctgaatgctggtgggcaatgttattctttacccgccaataaaccaccacatgcgttgcatggtatggcttgttactcaacgtgggaaatcatcgacaaaacagcagattccctgactttacgtatgcccctggcttcaccgtggccctggcaaggggaagtgattcagacttttttgctggagaacgatgcgctggttttgcaactggaagtccattcatatgccgatacattcccggcctccgcaggctggcatccgtggtttgcgaaaaagctgactccgcaaaatacagaatcgttgcaggtgctttttgatgcggactggcaagaagaagcgggtagtgatgaactgccaactggaaatcgtatctctcctcaagttggtccctgggatgactgttttggtttttatgacggggtgaaggttaagttactgtggcctggtaaactcgcgatgaccatgacctcttctgcaaacagtctggtggtatttgataaacagcccgatgccacctgtattaacccgctgactcaggcacctaacgcaataaatctaacgccggaatttgtgacaccagataagccgctggtcatcgaaactcgttggcaatttacacctgaatcttaaccattcatctattgcgaaaaagccagtgaaattactctgctttttcgcaatcagcatcacaagattacccttattgccacatagccaaacccaccctttcccgctacagttaatttcttgtggcgcgaaaggaggcaaaaatgctctatatctttgatttaggtaatgtgattgtcgatatcgactttaaccgtgtgctgggggcctggagcgatttaacgcgtgttccactggctacgcttaagaagagtttccacatgggcgaggcgtttcatcagcatgagcgtggggaaattagcgacgaagcgttcgcagaggcactgtgtcatgagatggccctgccgctaagctatgagcagttctcccacggttggcaggcggtatttgttgcgctacgaccggaagtgatcgccatcatgcataaactgcgtgagcaggggcatcgcgtggtggtgctttccaatactaaccgcctgcatactaccttctggccggaggaatacccggaaatccgtgatgctgctgaccatatctatctgtcgcaagacttgggtatgcgcaaacctgaagcacgaatttatcagcatgttttgcaggcagaaggtttttcaccagacgatacggtctttttcgacgataacgccgataatatagaaggagctaatcagctaggcattactagtattctggtgaaagataaaaccaccatcccggactatttcgcgaaggtgttatgctaaaaaccattcaggacaaagccaggcatcgtacccgtccactatgggcctggctaaaactactctggcaacgcattgatgaggacaacatgacaaccctggcaggtaaccttgcctatgtgtcgttgctctcattagtgccgctggttgccgttgtttttgcgcttttcgccgcttttcccatgttttccgacgtcagcattcagttgcgtcactttatttttgccaactttctgcctgctactggcgatgttatccagcgatatatcgaacagtttgtcgccaattccaacaaaatgaccgccgtcggggcgtgcgggctgatcgtcacggcgttattgttgatgtactccatcgatagcgcgttgaataccatctggcgcagtaaacgagcgcgacccaaaatttactcgtttgccgtgtactggatgattttaacgctggggccgctgttggcaggggccagtctggcgatcagctcctatctgctctctctgcgctgggcgagcgatctcaatactgtcatcgataatgtgttgcgtatttttccgctgctgttgtcgtggatctctttctggctgctgtacagcatcgttcctaccatccgtgtacctaaccgcgacgcgattgtcggcgcgtttgtcgccgcgctcctgttcgaagcaggaaagaaaggtttcgcgctttatatcaccatgttcccatcatatcagctcatttacggtgtgctggcggtgatccccattctctttgtttgggtctactggacatggtgtatcgtcttgcttggcgcggaaattactgtcactctcggggaataccgcaaattaaaacaggctgctgaacaagaagaagacgacgaaccatgattgcattaattcaacgcgtaacccgtgccagcgtcaccgtggagggagaagtgacgggtgaaattggcgcgggacttttggtgttattgggtgtcgaaaaggatgacgacgaacagaaagcaaaccgtctgtgcgagcgtgtgctcggctaccgcatctttagcgatgccgaaggcaagatgaatctcaacgtgcaacaggcgggcggcagtgtactggtggtttcccagtttacccttgccgcagataccgaacgggggatgcgcccaagtttctccaaaggcgcatcaccggatcgcgcggaggcgttatatgactatttcgtcgaacgctgccgtcagcaagagatgaacacgcaaacaggacgcttcgctgcggatatgcaggtatcgctggtcaatgatggccccgtgacattctggttgcaggtatgagccagcttccagggttgtcacgggaaacaagagagagtatcgctatgtatcaccttcgggttccacaaacagaagaagaattagagcgttactatcagtttcgctgggaaatgttgcgtaagcccctgcatcaaccaaaaggttcggaacgcgacgcgtgggatgcgatggcgcatcaccagatggtcgtcgacgagcagggtaatctggtagcggtaggccgactgtatattaatgccgacaatgaagcgtccattcgctttatggccgttcatcccgacgtgcaggacaaagggttaggcacgctgatggcgatgaccctggagtcggtggcacgtcaggaaggcgttaagcgcgtgacctgtagcgcccgtgaagacgcggtggagtttttcgccaagctggggtttgttaatcagggtgaaatcaccacgccaaccaccacgccgattcgccattttttgatgataaaacctgttgccactctggatgatattcttcatcgcggcgactggtgcgcccagctccagcaagcgtggtatgaacacatcccgctgagtgaaaaaatgggtgtgcgcattcagcaatataccgggcaaaaatttatcaccaccatgccggaaacaggcaatcagaatccgcatcacacgctgtttgccgggagtttattctcgctggcaacgctcactggttgggggcttatctggctgatgctgcgcgaacgccacctcggcggaacgattattctggcggatgcgcatatccgctatagcaaaccgattagcggaaaaccccatgcggtagccgaccttggtgccttaagtggcgatctcgaccgtctggcgcgcggacgaaaagcacgggtgcagatgcaagtagaaatctttggcgacgagacgccgggtgcagtgtttgaaggcacgtatatcgttctgcccgcgaagccatttggtccgtatgaagagggcggaaacgaagaagagtaggggcgttttacttgactgaaaaggttttcaatctgaaaaccttttctgggccctggtccggagttaccttcccgctctccaggcaacatcccgtagcgccgatcgcgcagcctcactgataccacctaactgaaaaaatccgtggataacgccaaggtagcgttggcaggtgcattgcactccttgccctgtcatgcggtgatacaacgcttcaccttcatcgcaaagtgggtcgtattcagcggtaatgatatgtacaggtggcaagccattgaaatcattgcgccaaatagggctggcttcaggatgcctgcgttcaatgcctggcaggtacatctcaaagccgctcagtaaagtgtcgcgtgtgatgatgtaatcgtgaccattgcgtatgtagctttcgaaatgcgcagtcgcatcaagcataggataaattaagatgagttgtgctggttgccactcgccagcacgcttcaatcgcaaagcagttaccagcgccagatgccctcccgcactgtcaccggcaagagttattcgttgtttatcaacgccgagtcgttcggcgtgttgccggactaattctgcacctcgttgtgcatcatcatgggcggcggggaaagtatgttccggtgccagccgatactggacggcaataatccgacattgcccgtaataggctaactggcgcagctggttgtcgtgagttgcgaacccgccgctaacaaaacagccaccgtagtaataaattatcgtcgggagtaatgtcggggcattcagcggtgacactattcgtaaggtcatcccttcaagttcgatagtctgaatatctacccgcgtttctgtctcacccgcaaggacagcgctggcgatatagccctctctgcgctgcgtaatactttgttggcgcgatgaggggcgacccgcagcgataaactcttcgactaactctgcaattcctttttccagtgccatagtagaactcattttgctgtatgaatgtacagttttatacacccgtttttgctggatggatacagggaaattcacgggcgtgaaaaatctggaaagcgcctcgcaaatgtaaagacaaacccggcagagacgtggttttgctggagcactatcagtaagctagtggtttcaatggtacgtcaatgacgtacaaaaaggattgttactctaagccaatggcgtataattatgctcttcatcgaaacggaaatttttactgaagatgttcaaaaactgctgaacgacgatgaattcagtcgttttcagtttttcctggccttgaatcctgactatggtgaggtaatacctgaaactggtgggttaagaaaggttcgatgggtctcaggaggaaaggggaaacgtgctggtgtcagggttatttactttcatcaggttaaacattatgagatcagattactgcttatttatcgtaagggtattaaagatgatctgtctccccaggaaaaagcaatgctccggttgttaaatacgaggtggtaaatggataaggcactttttgagcggttgactcacagcatggcccagatgaatgaaattattgaaggaacgcgacagccttcacggacttttgaagttgatgctatgaaaatcaaagaaatacgccgcgcttcagggttgtcacaatctaaatttgccgatcttatttccgtaagcgtagacacgttgcgtaactgggagcaggggcgacgttcaccgaccgggcctgcaaaggctttgctgcgagcgattgccaatgatccgcaacatgtgctgcaagcacttaaccgttagaggcatggttatgccatacagaaagcaccagcattcagaactcctatgaaagcggcatagtgccgcctgctcaggagttttgctatgacccgtaatcgtgctgaacgtcgccatcatatggtgcgattaaaaaaaatccgctgtcgttatcgcactgcaggcgatggaagcaaaaaagcatcaggtatttgctttcgtactccctgtatttgttcttgttggatgtgtgggcatcgacgctatcataatggtccccgcgtatcggaaattcgtgcaaaagcacgctatgcgaattaagggaaaatgatgaactattttaaggaagcacatttttagaactcttaacaggagactaaaaatgtccacgtttaatacgcgtaaagatagggatcgtaatggtaaagcgaagccgcataagcattcagggatcccaacacttacaggtaaatggcgtcacccttcaatggattgttgggtaaactacagtacaccgggcgatcatgaatggaagcggctctatactacgcttcgccgtcgcgcagatgatcgacgccaatgtcatcgggtaatgcagggggatgatccggaaggaatcgtctggttcccggactgttatccacaaatttactactactaacaattaaagaccggttggtgcggcactgaccggtcgttatgaatggtagatttcaccttaaaccctggtgcggtaaagctgctgactttttcgggtacaccatcctgatgaagcaaatgaagacccaatcaaaaaatattcttgaatataaaatatttatagcatccataattcatccttattatttgttgtttcttttctgtagatgtgcccccgcttaattaaaagtaataaaccatttttgagtaacaattgaaataactgaaactgttacattatctttggatgccgtctcgcaaaaataaaacaatatgaaaaaatccgctttcgttaattaactttccggcgtaattttcgcacatacattaatgagtaatatatgtaaggtggtggtaatggcgatgaatacggtttttcttcatttatcagaagaggcaattaaacggctgaacaagcttcggggatggcgtaaggtttcgcgctctgcaattttacgcgaagcggtagagcaatatctggagcggcagcaatttccggtgcgtaaggcaaaaggcggcaggcaaagggacgaggcagttggtgttgaagaactatgtaagcagcataaggaatgacaaaagtttttttattcatgaatataaaaaaccagatgcccttattctggtattaatacaaggctgttttacttgaacttataataactgcaactgttacatcatatctggaaaacgcctcgcgaaatacgagagattttgcgggaatagcaggtgtcgtcacaccctatgagctgtaatccgggcgaccagcgccacccggaaaacgtcagagattactccccttcacccggaaacaggaacgggttaatggaactacgggcatagccttcttgctccattcgcgcgtccagtaccagagaggcgaggtcatctgccacggcttcaactttcggttctttttcctgataaagaatcttcaggtaagtgccgcagtcatcgcagctttcggctttaatcgcggcctgttcgtcatccagcgaccagtaatgcagtttgccgctttgttcacagttgctgcattttacgcgcactacgtgccattcagtttcacacaggttgcagtgcaggtaacgcagaccctgagtggtgccaatttgcaccatgctggacaccggcatagagccacataccgggcaatattgacgttgttcgccgtattcagcgcgggctttgccggggatcagattagccatctgcgcccagtagagcgacagcgcagcccagataaacggcgctttatcgctgctgacggacgagaaatcagaggcaaacagtgcgctggccatatcttccagctcctgagtcgatgccttctccagattctcaatcactgccagcgccgggccgctcatttcaggtttcagctcagcaatcagcgccatcagcagcttttgccagtgcttatcacgcggcagaacgtgaatatccagcgggggcttgccttgtgcgctggcttctttaatgcgcgtggtcagatccatctccagcggatggtcgtacagcaccacttcctgggcgtgggcgataagcgcagcaaagcgcaggtaatcacccagcggattattttctgccagctcgcgcagacgctcggcgcggcggttgtataaattcttgagccgagggaacaataacggcggaatcatatccgccgtacgtttctcgctcgaacccagctcatcttgcgggattatgcgaatactcattcagctttcttttccgttgtcttgcggacctcacggtaccagcgcgggtgatgtttctttgcccatgcgctggtcacccatccttccaccatggcggtaatcgtgcctttcacccaaagggcggcgtagatatgcaccatgataaccacaattaacgccactgcggcaaatgaatgcagcattaacgcgaatcggatcaccgggattgagaaagcaggcgcaaaataaggacgccagataatcacgccgctcaccagcaacaggaccaggaaaataatcgccgcccagaaaacgcatttctgaccgaagttataacgcccggtgtcacctacttcctcgttgacgacgatcttacgaatattcttcgcccaaaagatatcatcccgattgattaggttgtgatgccagtaacggaaaaacatgatgatgaacgaggcaaacataaccacgccgacaaacgggtgcagaatgcgcgccagctgcggtgtgcccatgatttgcatcaaccagttgaaggacgggaacaaaaagcccagcccgctcaccgccgccaggatgaagcagaaggcggtgatccagtggttgatacgttccggcgcggtgtagcgcacgatggtgtcacgtcgtttcatttgcgctcctcgtctttctcttcgtgcagattattctcttcctcatccgcacggttcggaccgacacccacgtagtggaagatactggctgcgaaggtagccgcaaagccaacagctgcgagcggtttccagatgcctttccagaatttcacggtttcgctgatttccgggttctccggcaagccatgatacagatttggcttgtcagcatggtgcagcacgtacataacatgtgtaccaccgacgcctgccgggtcgtacaaacccgcattgtcgtaaccacgggttttcagctccgccacgcgctcgctcgccagcgttttcatcgactctttcgtaccgaagtgaatcgcgcccgttgggcaggtcttcacgcaggccggttcttgcccaaccaccacgcggtcaacgcacagcgtacatttgtagacgcggttgtcttccgggttgaggcgcggaatgtcgaacggacagcccgcaatgcaataaccgcagccgatgcactgctcggactggaagtcgacgataccgttggcatactgaataattgccccttccgccgggcacgctttcaggcagcctggatcggaacagtgcatacagccgtctttgcggatcagccattccagtttgtcgttctgctccacttccgagaatcgcatcaccgtccacgatttggcacttaaatcattggggttgtcgtacaccccaatgttattgccgacggtatcgcgaatgtcgttccactctgaacacgccacctgacaggctttacagccgatacaggtggtaacgtcgatgagtttcgccacttcttcctggaagtcccgcgcctgaggcgcgggggtcagaccgttagtcgcggaacgacgaatgatatcttgcgattgataagccatatgtcgtctccgttacaccttttccacattcacaaggaaggacttaaactccggcgtctgcgtgttcgcatcaccgacgaatggcgtcaacgtattggcaataaagccttttttcgcaacaccttcatagccccagtgaataggaataccgatggtatcgatatctttgccgtttgctttcagcgtgcgaatacgtttggtcactaccgctttggctttgatatagccacggttggaggagactttcacagtatcgccctgggcaatgccaagtttattcgccagcgactccccgatttccacaaactgctctggttgcaaaatcgcgttcaacagcgcgtgtttggtccagtagtggaagtgctcggtcagacgataggtggttccgacatacgggaacttatcggctttacctaatgcttcggcatcgtctttaaagatacgcgccgccggattcgagataacgtttggatgcagcgggttagttcccagcggcgtttcaaacggctcgtagtgttccgggaacggaccttccgccatcttatcgagggcaaacagacgtcccatgccttcctgctgcatgataaacggccctacgccgctgcccggaggcgctgcgctgtaatccggaatatcccagccggtccacttagtgccgtcccatttcagcaactgacgcttcggatcccacgggttaccctgcggatctgcggaggcgcggttatacagaatgcggcggttaagcggccatgcccatgcccagcccagcgtgttaccgaggccagacggatcggcgttatcacgacgcgccatctggttgccttccggcgtccagctaccggcgaaaatccagcagccacaggaagttgtgccgtcatcgcgcagttgggcgaacgagctaagttgttggcctttcttgacgataaccgcaccggttgccgggtcggtaatatcggccagcgctttgccgttgctctccattgccacttcttctgaagatggctcatgcggaatggcgtagttccaggtcatgttcagcacctggtccgggttcgcgccaccctgttcggcatacatcttgcgcaagcgcaggaagataccggagaggatctcgccatcagtcagcgcaatccccggggcgtccgcacctttccagtgccactgtaaccagcgacctgagttaacgatagaaccgttctcttccgcgaagcaggtcgatggtagacggaacacttcggtctggatcttcgacgagtcaacttcgttcagctcaccgtggttctgccagaagttagaggtttcagtgttcagcgggtcgatagtcacgaggaatttcagcttcgacagacagccgatcactttgtttttgttcgggaatgaggcaacagggttaaagccctggcagatatagccattgaccttgccttctttcatcatctcgaagtattgcaggacgtcgtagcctttatcccacttcggcaaccagtcaaagccccagctattttccgccgtcgctttatcaccaaagaatgccttcatcatagagacgaagaatttcgggtagttgccccagtagttaacctggccttccagcagtggtttcggcgtgttggcggtaaggtaagtttgcagatcggtctgcttctcgcttggcagcgtcatgtaacctggcagactctgcgacagtagccccaggtccgtcagcccctgaatattggagtgaccgcgcagggcgttaacgccgccgcctgccatccccatgttgccgagcagcagctggatcatcgccatcgtacgaatgttttgcgcaccaatggagtgttgcgtccagccgagggcgtagaggaacgacgctgttttatcgtgagcactggtttcggcgatgtattcgcagactttcaggaacgcgtcttttggcgtaccgcagatgttttcaaccacatctggcgtataacgggaaacgtgctgtttcagcaagttccacacgcaacgtggatgttgcagggttgtatcacgtttggcgaagccgttttcgtccagttcgtaagtccaggtggacttatcgtacttgcgtttttccgcgtcgtagccggtgaacaggccatcttcaaagccgtaatcctcacgcacgatcaggctggcgttggtataggcttcggtgtattcgcggttgaatttttcattgttcagcaggtacagcaatacgcctgacaggaaagcaatgtcagtaccggaacggataggggcatagtagtcagccaccgccgctgtacgtgtaaagcgaggatcgataacaatcagctttgcgccgttgtgaattttggcttccatcgcccagcggaacccgaccgggtgagcttcagcggcgttaccgcccatcaccacgacgaggttggcattcttgatgtcgacccagtggttggtcatcgcaccgcgaccaaatgttggagcaagacttgctaccgttggtccgtgtcagacacgcgcctggttgtcgaccgcgagcatacccagcgcgcgggagaatttttgcgttaaatagccggtttcgttactcgacgcggaagcacacagcatcccggtggagagccagcggttaacagtcacgccttcggcgttttgcgcaatgtagttagcatcgcggtcttctttcatcagtttggcgatgcgatcaaacgcctcttcccaactgatttgttgccatttatcagaacctggcgcacggtattccggaaacttcagacggctttcggagtggatgaaatccaccaggccagcgcctttcggacaaagtgctccgcggttgaccgggtgatccgggtcaccttcgatatggaagatagatgctttggcgttttttgctccgtcaccgaggctgtacatcaacagcccacagcctacggaacaataggtgcaggtattacgggtttcgcgggtgcgcagcagtttatactgccgggtttccgcgagtgctacgctgggtgcaaaacccagtgccgctgccgtggtgcctgccataccgccagcgcagatcttaaagaactgccttctgctgacctgcatggattgctccttgtttcgacattgtcacgtcccatttacattcgcttgctgcgtgtgcagggagtgggagttatttttctttgcggaaggggccgcaaaggtccagaattggctcaatttccctccatccaggaaggatttgtaacagaataccataatgttggtgtgtgtgttcttatctggttaatagaaagtgaaaaaaacacagcaaaaagaaatcgagaatgtgacaaatatcacaggtgttcgtcaaattgagttatggcggcgtgatgatttacaacacccacggttagatgaggtggcggaagaagttcccgttgcgctggtctacaacggcatttcgcacgtggtgatgatggcgtcgcccaaagaccttgagtactttgcgctcggtttttcgctttccgaaggaattatcgaaagcccgcgcgatatcttcggcatggatgtcgttccttcctgtaatggcctggaagtacaaattgagctttccagccgccgctttatggggttgaaggaacgccgccgggcgctggcgggacgtacgggctgtggcgtatgcggtgtagaacagcttaacgatatcggtaaaccggtgcagccgctgccgttcacccagacgtttgatctcaacaaactggatgatgcattacgtcatctcaatgatttccagccagtggggcaactgactggttgtactcacgccgctgcatggatgttgccatctggcgaactggtcggcgggcatgaagacgtgggtcgccatgtggcgctggacaaactgttaggccgccggtcacaagaaggggaaagctggcagcaaggtgcggtgctggtttccagccgtgccagttatgaaatggtgcaaaagtcggcgatgtgcggcgtagagattttgtttgcggtgtctgccgcgaccacacttgctgtagaagtggctgagcgctgtaatctgacgctggtgggcttttgtaaaccgggtcgggcaacggtttatacccatccgcagcgtttgagcaattaattaaaataagtcctgcgatatatattaaattacaggacttattcatttcgtgaattttgttattttttcataaacaaaacgcgtgtagtggcgttaacgcctgcgctgcaacctattgatggcgtggcggtgagttatattgatgctgccgtagcgttgggtaataccattaacgaaatggataaatattacacccaggaaaattataaagacgatgcgtttgcgaaagggaaaacgctgcaccagacattcttaaaaatctggaagcctttgaacctgtagcagaatcttatcatgcggcgattcaggaaattaatgacaagcgccagcttacggaattgaaaaatattgaagaaagagaagggaaaacattccactactactctctggcagtcatgatttcagcgaaacaaattaataacctgatatcgcaagataagtttgatgcagaagcggcaatgaagaaagtgtctgaactggaaacgctggtggcgcaggccaaagaagcggataaaagcggcatgaatttctcgtttattaattcggcaggccagtatcaactcgaggctaaaaaatacgttcgccgcatcagagataaagtcccgtactctgactgggataaagagcaacttcaggacgcaaactcaagctggatggccgaagactcatttccacgagcgttatgcgattacaacgaaatggtcgatgaaatatttcagttaattgtaatcgcggggcgggtttgtgatgagcacggatatgtcacgaagtcgtaacaatataaagcagagtgaaggataaattttgtgaataaagtatcattatttaatgattttgtgaatgttaaaatgtctcagataatttgtttaagcgttatttatatttgtggcttatgagtcagcgtgaatcatatctaatattttttacgatatttagttaaaaacggcactattgttatattcctcacgttccaggaaatcagcggatttactcatattatgcggcgggatactatccatcggcctgctgaagttggattaaaaattcgaaagtgcacaccttatatttctctatatacgtattccttttggaaagcgtagggtctcctttatttcagggaacgtaaataatgaaaaaatcgacattatctttagccatcggtttattattggcatgtagtaccggtatggcaaaaacacagcatttaacgctggaacaacgcatggcattgctggaagaacgcctggaagcggcagaaatgcgggcagcaaaagcagaggggcaggttaaacagcttcagacacaacaagccgccgagatccgcgaaattaaaaccgcacagggcaacacgccggtaaacggtcaatcaacgacggagtcagagaagaaaaacgccaccccgcctaatctcctgctttcagggtatggcgatttaaaaatctacggtgacgtcgaatttaatatggatgcggaaagtaatcatggcctgctggcaatgaccaacgctgatgtgaatagcgatcccactaatgaacagtggaatctcaatggtcgtattctgttaggttttgatggtatgcgaaaactggataatggctatttcgctgggttctccgcacaaccgctgggggatatgcacggttcagtaaatatcgatgatgcggttttcttctttggcaaagaaaacgactggaaggtcaaagtaggccgttttgaagcctacgatatgttcccgctgaatcaggatacctttgttgaacattccggtaatactgcgaacgatctttatgacgatggcagcggttatatctatatgatgaaagagggccgcggacgttctaacgctggcggtaatttcctcgtcagcaaacaactcgataactggtattttgaattaaacacgttactggaagacggaacatctttatataacgacggtaattatcatggacgcgatatggaacagcagaaaaatgttgcttatctgcgtccggtaattgcctggtcgccgacggaagaattcaccgtttccgcagcgatggaagcgaatgtggtaaataatgcttatggttataccgatagcaagggtaattttgtcgatcagtccgatcgtaccggttatggcatgagtatgacctggaatggcctgaaaaccgatccggaaaatggcatcgtggttaatcttaataccgcctatttagatgctaataatgaaaaagatttcacggcagggattaacgcgctgtggaaacgtttcgagctgggttatatctatgcacataataagattgatgaatttagtggcgtggtttgtgataacgattgctggattgatgatgaaggaacatacaacattcacaccattcatgcgtcttatcagttcgctaatgtgatggatatggagaactttaatatttacctcggcacgtattactccattctggatagcgacggcgataagatacacggcgacgatagtgatgaccgttacggcgcacgcgttcgctttaaatacttcttctgatgaaagggcggtgctggatattttccggcaccgcaactcattaaggcaggtaaaacacttcttgcagttcgctactgactgggctgttatccgcattagcgggcataacgtcggtcatatatttccaccaacgttggcaaacatctgtactggcaaccgcattccaccgttcttcagattcaatctctaccgtggcaaatagcagattatgcgctttgtcgagatagatggcgtagttatgcgcaccgtgagatttcagcactgcttccagttccggccagatgggattatgccgacgctgatactcttcgtgggcgtcggggtttacctgcatgacaaaggctttgcggatcatgtttgctccttacagcgccagcgcactggcgagtggtgtaacgccgaaacgctggccgagcgctatcaactcttcacggctgatggtctgtttcatgccgcccatcgaataaaccttcactaatatttgtgctgatttttctgcggtgtcgattaaaccgaaggtttcatccagtgtcggtccggaaccgaacacaccgtggaagggccacaacaccagcgaatgtttttgcatctcttgtgcagttgcctggccgatttcgtccgtgccgggtaccatccacggcagaatgccaacgccatccgggaataccaccagacactcggtgctgccttcccacagttggcgagtgaagaccgcggtgtcgttttccagcacgtaggtgagagcgatcaggttagtggcgtggcagtgcatgatcacccgatctttgccgttggtggctttaatgcgctcgcagtgggaaaggaagtgagctggaagttcggaagtggggacggcttcgttggttaacccccaaagaatgtggtagcccgcgccgtcgctgtcgacttttacgatgcctaagttagccgcaggatcaagctggacgttacggaagaatttgccggagccggtgacaataaacggtgtatttgccagtaaaggcatgggctggctgagcgggatatagcgcggttgttggtgaaaattgtcgtgatatggtgcgatatcggcgtcatccaggcgcagcgtcaggttgccgccgttgcgctcgtcccagcctttcagccaggcatcggtggtggctttgatcattccctggacaaaccaggactgggttatgttttgcatgttctgtgttcctgttaattggacgtccgtgcctgttgccggatgtacgacccgtaggccggataaggcacttgtgccgcatccggcaatcaatgcctgatgcgacgctgtcgcgtcttatcaggcctacaactgttgctgacccgtaggccggataaggcactcgtgccgcatccggcaatcaatgcctgatgcgacgctgtcgcgtcttatcaggcctacaactattgccgacctgtaggccggataaggcacttgtgccgcatccggcagtgtttacccgcggcgactcaaaatttctttctcataagtccgcacgttctccagccattcgctacccgctggcgtatcgtgacgctgacaatacatttcccataccgcctgccatggcaacgatttctgctcttccagtagcgccagacgcgcagtgtaatcgcccgccgcttccagcttgcgtagttcagcggtaggttccagcaacgcacgtagcagggcttttttcatattgcgtgtaccaatgacccacgcggcaatgcggttgatagaggcatcgaagaagtcgaggccgatatgcacccggtcgaacagatcgtgacgaacaatctcactggcaatcgcctgggtttcatcatccagcagcactacgtgatcgctgtcccagcgaaccggacggctgacgtgcagcagcaactgcggcacatacagcatggcggcggaaatcttgtcggaaatcacttcagtcgggtggaaatgcccggcgtccaggcacagcgctgtctggcggctggtggcataccccaggtaaaactcattggagccaaccgtgtagctctccgcgccaatgccaaacaatttgctctcaacggcgtcgatatggtgcgcagggtttagcttctcgctgatcacctcatccagtgctgccagcaaacgctggcgtggggcgagacggtcaacggtgatatctttcataccatccgggatccagatgttcatcaccgatggtgtgccgagttgctcgccaaaataggctgaaacacggcggctggctttacagtggtcaatccagaactggcgaatgcggtcgtcggcatgggaaagcgtaaagccatcggcgcttagcggatgcgaaaaacaggaggggttaaaatccagaccgagctgattggctttcgcccattcaacccagtttttgaagtgctctggtttgatctggtcgcgcgagactggcgtgtctgattccagatagatggcatgtaaattaagccgtttcggccctggaatcagccgcatagcctgttccagatcggcacgtagctcactggcattacgcgctttgcccggataattaccagtagcctgaataccaccggtcagcgaaccttccgggttttcaaaaccggaaacatcatcgccctgccagcagtgcattgaaacgggtaaacgatcaagttggcgcagtgcctcctcgacatcaatccctactgccgcgaaacgctgtttcgcaagctcccaggcctgttccagttgagtggtcatgcgcaaagctcctttgtctgtcgtgtagagtgaatctgcgccacatagtgggcaatttcactgtcaggattaggggtaaaggtggtcagattcgcggtagtgctgacgacctgacggaaatcatccacattgttgagttcatccagcgtcattaactggatgccgatattgccgagcgtcgaggcttcaacaggccctgcgatcacccgaataccgcaggcatcggcacacagctggttgagcagcgtgttctggcagccgccgccgacaatatgcagttgcgagaaatcttcaccacgcagctgcgccagctcatgcaacacatcggcatacagcagcgccagactgtcgaaaatacagcgcgccagttcagcatcactttccgggatcggttgcgccgtttcccgacacgcagcctgaatttcgctgcacatctcgtcaggattaataaagcgatcgtcattgggattgatgatgaagcggcaggccggaagtgcctgtgttgcggcgataagcgccggaagatcgttgatttgccgctcctgaagcactcgctgaagcagccataagcccataatatttttcagcacccgatagcgaccttccgccccgccttcgttggtgatattggctgccagcgccgtgtcattggtaaatggcgtctggctttcgaagcccatcaatgaccaggtgccagaagagagataagcggcgcgtgaaccgtttaacggcgaggcgataaccgcgctggcggtatcatggctggcaacggcgaccaccggaatctcattaccctgcgggcaaatccagtgacctatgacattacccggatgcgtcgggcgaccaaaccaggctttgttggcaccgctccacgccagtagcgactcgtcccagtcgtcgctattgatattgaccagttgcgtggtcgtggcgttggtatattcccagttcatcttgccggtcaggcgataactaaagtaatccggtatcagcaaagcgtgagcaatgtgtggaataagttctggttgctgctctgtcagtgcacgtagctgatagatcgtattgaagggcagaaactggatgccgctacgttgataaatatcgcgtttgccgagttgttgttgtgcctgcgccattaggccattggtgcggctatcgcgataagcaacgggcaggcccacacgctgaccctgttggtcgagcagcacaaagtccacgccccaggtatcaatcccaatgctatcgatacgaatcccttcctcgcacaccttgtttaatccaaggcgaatggcactttccaggctatccacattccaggtgacataaccgttctggctatgcaggccattgttaaaacgatggatttcgcgcagcgtcaggctgcggcattcacgctcgtaacgcgccagcatcacgcgcccactggatgcgccgagatcgacggcgacacaattgcgaaaggtcataatgtgatcctgctgaatttcattacgaccagtctaaaaagcgcctgaattcgtgaccttctcgttactgacaggaaaatgggccattggcaaccagggaaagatgaacgtgatgatgttcacaatttgcttcattgtggtgatgtgatgctcaccgcatttcctgaaaattcacgctgtatcttgaaaaatcgacgttttttacgtggttttccgtcgaaaatttaaggtaagaacctgacctcgtgattactatttcgccgtgttgacgacatcaggaggccagtatgaccgtattacatagtgtggatttttttccgtctggtaacgcgtccgtggcgatagaaccccggctcccgcaggcggattttcctgaacatcatcatgattttcatgaaattgtgattgtcgaacatggcacgggtattcatgtatttaatgggcagccctataccatcaccggtgggacggtctgtttcgtacgcgatcatgatcggcatctgtatgaacataccgataatctgtgtctgaccaatgtgctgtatcgctcgccggatcgatttcagtttctcgccgggctgaatcagttgctgccacaagagcaggatgggcagtatccgtctcactggcgcgttaaccacagcgtgttgcagcaggtgcgacagctggttgcacagatggaacagcaggaagaggaaaatgatttaccctcgaccgccagtcgcgagatcttatttatgcaattactgctcttgctgcgtaaaagcagtttgcaggagaacctggaaaacagcgcgtcacgtctcaacttgcttctggcctggctggaggaccattttgccgatgaggtgaattgggacgctgtggcggatcaattttctctttcgctgcgtacgctacatcggcagcttaagcagaaaacgggactgacgcctcagcgttacctgaaccgcctgcgactgatgaaagcccgacatctgctacgccacagcgaggccagcgttactgacatcgcctatcgctgcggatttagcgacagtaaccacttttcgacgctttttcgccgagagtttaactggtcaccgcgtgatattcgccagggacgggatggctttctgcaataacgcgaatcttctcaacgtatttgtacgccatattgcgaataatcaacttcgctctctggccgaggtagccacggtggcgcatcagttaaaacttctcaaagatgatttttttgccagcgaccagcaggcagtcgctgtggctgaccgttatccgcaagatgtctttgctgaacatacacatgatttttgtgagctggtaattgtctggcgcggtaatggtctgcatgtactcaacgatcgcccttatcgcattacccgtggcgatctcttttacattcatgctgacgataaacactcctacgcttccgttaacgatctggttttgcagaatattatttattgcccggagcggctgaagctgaatcttgactggcagggggcgattccgggatttaacgccagcgcagggcaaccacactggcgtttaggtagcgtggggatggcgcaggcgcggcaggttatcggtcagcttgagcatgaaagtagtcagcatgtgccgtttgctaacgaaatggctgagttgctgttcgggcagttggtgatgttgctgaatcgccatcgttacaccagtgattcgttgccgccaacatccagcgaaacgttgctggataagctgattacccggctggcggccagcctgaaaagtccctttgcgctggataaattttgtgatgaggcatcgtgcagtgagcgcgttttgcgtcagcaatttcgtcagcagactggaatgaccatcaatcaatatctgcgacaggtcagagtgtgtcatgcgcaatatctcctccagcatagccgcctgttaatcagtgatatttcgaccgaatgtggctttgaagatagtaactatttttcggtggtgtttacccgggaaaccgggatgacgcccagccagtggcgtcatctcaattcgcagaaagattaattcgccatgccgatgccgacgatgttagcggcaacaataatcaccacacaaccgaggctcaacaccgttaccggacggcgtcctgcattgttccactctttcagcaccagcccaacgataccgccgcacaatacatagaagctcatatgcagcatccaactgatgtagtcatactgcgccggaatgcgggcgtggccccaggcatagaaaaagaattgcagataccacatcaacccacccagagctgagagtagcacattgtgaatgatcagcggttttgccagcgagaagtcggcttttagcgacaaatctttcacttttgccagacgaatgaagcagaagccgaggttgatgattgcgccgccgcccatgatgacaacatagcttggcagagcgacatacaggggatcgacgcccagcgcggcagcggcttcatgcatcggttttgcggcgttcatcgcaaaggacatcccggcagagaaaatgccgcacatcaccgccagcaccagcccttttttcagattgaactcttctgctttaatgcccatcttgcgctctttcaactgcccggcgcgagttacaatccctacgccaatcagcgccaccagaacgccgagcaacgtcatgcgtccgccttcggtattaatcagcacatcgaaattgccgttgataattggcgtcatcagcgtaccgacaatcaacgtaatgccaatggcgatgccaattcccatcgacatgccgagataacgcatggtcaggccgtagttgatattaccgatcccccacatagcgccgaacagaaaaacaggcagcagcgtagagagactaaacgagctgtaatacgcccagaaattcggtagtaacagggcgctgatggcccacggcaggataatccacgaaacaatcccaccgactgaccacatggtttcccatgaccatttttttacttttttgaacggagcgtaaaaacaggctgcactggccgcgccgatcaaatgccaaaatatccccatcgtaatcgcgttactcatcttcttatcctcatcatttttcgtcgcgtcacatctccgacgagatgagtgtaaaaatcgtgctgtcgattaacctttcgcctgttgccgccgctgccgatttactggcaatcacggcattaagtgggtgatttgtttcacatcttgggcattttcctgcaaaaccatacccttatgaaaagtgcggcattgataatcattttcaatatcatttaattaactataatgaaccaactgcttacgcggcattaacaatcggccgcccgacaacactggagatgaatatgagttataccctgccatccctgccgtatgcttacgatgccctggaaccgcacttcgataagcagaccatggaaatccaccacaccaaacaccatcaggcctacgttaacaacgccaacgcggcgctggaaagcctgccagaattcgctaacctgccggttgaagagctgatcaccaaactggaccaactgccagcagacaagaaaaccgtactgcgcaataacgctggtggtcacgctaaccacagcctgttctggaaaggtctgaaaaaaggcaccaccctgcagggtgacctgaaagcggctatcgaacgtgacttcggctccgttgataacttcaaagcagaatttgagaaagcggcagcttcccgctttggttccggctgggcatggctggtgcaaaaaggcgataaactggcggtggtttctactgctaaccaggactctccgctgatgggcgaagccatttctggcgcttccggcttcccgattctgggcctggatgtgtgggaacatgcttactacctgaaattccagaaccgccgtccggactacattaaagagttctggaacgtggtgaactgggacgaagcagcggcacgtttcgcagcgaaaaaataatcatttgatgcctgctgcaatgaggcgtttacgccgcattgcagcttaaaaaatgaaccatcgccaacggcggtggtttttttgtgatcaatttcaaaataaaaacaatgatccgataaaaataaaacagcgtttcaattgatgtggttttgatcacttttattgatcaaatgaatgtctatcttcgtttccatcaacactgatgctccgttgaggaatgacgcatcagcccttaaaaatatgccgacaggtgatggaaatgcagataaaacgctcgattgagaaaatcccgggggggatgatgctcgtcccgctattccttggcgcactgtgccacaccttctcgccgggggcggggaaatattttggatcattcaccaacgggatgattaccggtacggtgcccattctggcggtgtggtttttttgcatgggggcgtcaataaaattaagcgcgacgggaacggtactgcgtaaatccggtacgctggtggtaactaaaattgccgtcgcgtgggtggttgcggcaattgcctcgcgcattattccggaacatggtgttgaagttggattttttgccggactttcaacgttggcgctggtggcggcgatggatatgaccaacggcggactttacgcttccatcatgcagcagtacggcacaaaagaagaagctggggcatttgtgttgatgtcgttggagtccgggccgctcatgacgatgattattctgggcactgccgggattgcctcgtttgaaccgcatgttttcgtcggcgcagtattgccgttcctggtgggctttgccctggggaaccttgaccctgagttacgagaatttttcagcaaagcggtgcagacgcttattccattctttgccttcgcactgggcaataccattgatttgactgtaattgcccagacaggtttgctggggatcctgttgggtgtggcagtaattatcgtgaccggtattccgttgattatcgccgataaattgattggcggtggcgatggcactgccggaattgccgcttccagttccgcaggggccgcggtagcgacacctgtgctgattgctgaaatggtgcctgcgtttaaacctatggctccggcagcaacttcgctggtcgcgacggcggtcattgtgacttcgattctggtgccaattcttacctctatctggtcacgtaaagtcaaagccagagcggcgaaaatcgaaattttaggtacggtgaaataaaccagcttccttaatccccacagccggatgaactaacgttcgtccggttttcaattgcgtttctgcctggatacttaccgcgaaaacagcacgcctgacataaaataaatatggtctaatagggaaatttctcgtggagagggaacagatgcgatatccggttgatgtatacacaggcaagattcaggcttatcccgaaggcaaacccagcgcaattgccaaaatccaggttgatggtgagttgatgctgacggacctggggctggaaggtgacgaacaggcggagaaaaagatccacggcgggccagacagagcgctgtgtcattatcctcgtgagcattatctctactgggcgcgggaatttccggaacaggcggagctgtttgttgcgcctgcgtttggcgaaaatctctcaaccgacggtctgacggaaagtaatgtttatattggtgatattttccgctggggagaggcattaattcaggtcagccagccacgctcaccttgctataaactcaattaccattttgatatcagcgatatagcgcagttgatgcaaaacacgggtaaagtggggtggttgtatagcgtaattgcaccagggttggtatctgctgatgcgccactggagttggtttcccgtgtcagcgatgtgaccgtgcaggaggctgccgccatcgcatggcatatgccgtttgatgacgatcagtatcaccgtttactctccgccgcagggttatcgaaaagctggacgcgaacgatgcaaaagcgccgactgagcggcaagatcgaagatttttcccgccgattgtggggaaaataacccccggagtgtaggcctgataagacgctatcagcgtcgcatcaggcatcctgctcaaatgccggatgcggcgtaaacgccttatcctgcctacaaatgcggagtttaactccgcttatacagcggcaaccaaatcaccagccgtaaaccgcccagcgggctgtcttctgccttcacccagccacgatgctgctgaatggcggtttcaacaatcgccagccccaaacctgtacccccagattcacgatcgcgtgcttcgtcggtccgatagaacggacggaaaatctgttcgcgatcttccgggctaacgccaggaccatcgtcgtccaccgtaatggtgataccgtctttatctaccgcaaagcccacttcaatcttcgtatgggaataacgcagagcattacgaacaatgttttccagcgcactttccagggcgttcgggttgccgtacagcggccacggcccaggtgggaagttaaccgtcaacgacttgcccatttgctcggcttcgaacgccgcgttatccagcacttcactccacaactggttggctttgatggtctcgctaaccagcgcatttttctgctgattacgtgacatcaccaacagatcgttgatcatgctgtccagacgttgcgcttcagtttcaatacgctccagttccttgctttcaccgctacgacggcgcagtaacgccgtacccagttgcagacgcgtcagcggggtgcgcagttcgtgagagatatcagaaagtagacgctgctgagaggtcatcatgcgctccagcgcggtgaccatctggttaaaactggcaccggcggcaaggaattcctgtggccccgcttccagttccgggtgctggcgtaagtttccctgggcaacttcatcggcagcgtttttcagcttacgcgccggttttgccagactccaggccaaccacaacagcagcggcgtactgaccagcatggtgacaatcagcagtaataacgggcggtcaaacagtaagtttatgaaatcggattgagaactgctggccggacgaatcagataaagttggtaattatcttcgccatcacgcacggagaacggaccgaccagttccacgcggccatactttttcttctgcggatgatcggcgttatcggcctgaccaataaagttacgaatgatctgcatttcgctgcgttcagcgccgatcacgcggccttcggtggtcaccagtaacaaacgctgtcctggtggtgcccacttatcaatcgcccggaacagacgccgccaccacattaaatcgttgggcggatcgttcgccagctccgcttcgacatgctgctcaatcatcagcccctgacgctgttcgctatccagaagctcggtcatctggcgtgaatcgagcttgggtaacatcaaaaccaacatcaacaccagcgccagcgtcagccagaagatggcgaagatgcgcgcggttaagctgcctatcatgaagcagaaaccatcagatagccgcgaccacgcaaggttttaaaccacgggtgaccatctttacgatccggcagtttacgacgcaggttggaaatatgcatatcgatagcgcggtcgaaaggcgtcaggcgcttgcccagcacttcctggcttaaatgctcacgggaaaccacctgacccagatgctgtgccagcaaatagagcagggtaaactcagtaccggttaactccagtgtttgcccgtcgaaggtggcttcctggcgaccaggattgagacttaaggcatcaacttccagtgtcggtgaaccgttgtcgttgttttgctgttgttcgctccagtgcgaacggcgcaggatcgcgcgaatacgtgccaccagctcacgatcattaaacggttttgggagatagtcatctgcgcccagctcaaggccgagaacgcgatcaagttcactgccgcgcgccgtcaacataatgacaggcgtctggtgtgtctggcgaagtgcttttaatgtgtcgataccatttttcttcggcatcattacatcaagcaaaagtaaatcaatgctgtcgtccagaagatcaagcgcctgttccccatcgtgggcaacaatcacgttgaagccttccatctcgagcagctcctttaatagggaagtcagctctcggtcatcatcaactaacaggattttattcattgtttaaatacctccgaggcagaaattacgtcatcagacgtcgctaatccatgactttacgttgttttacaccccctgacgcatgtttgcagcctgaatcgtaaactctctatcgttgaatcgcgacagaaagattttgggagcaaatgatgcgcatagttaccgctgccgtcatggcctcaacgctggcagtcagttcattaagccacgctgctgaagtcggttcaggcgataactgtcatccgggtgaagaacttacgcagcgcagtacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaatagctcgtcaggttgagatggcaaaagtccgcaaccaaatgtatcgcctgttaacgccggagcagcaagcggttttaaacgagaaacatcaacaacgaatggagcagttgcgcgacgtgacgcaatggcaaaaaagttcatcgttgaagctattgagtagtagcaactcacgttcccagtagtaaaccctgttttccttgccatagacaccatccctgtcttcccccacatgatgtgggggttttttttatcctcaatttgcctgctgcttaatgcattgcagatgatttgcttccgttatactaccgtcagttgatagcgggagtatttatgaatcaatcttatggacggctggtcagtcgggcggcgattgctgcgacggcgatggcttcgctgctattgctgattaaaatttttgcatggtggtataccgggtcggtgagtattctcgccgcgctggtggattcgctggtggatatcggcgcgtcgttgacgaatttactggtggtgcgatattccctgcaacctgccgacgataatcactcgtttggtcacggtaaagctgagtccctcgcggcgctggcgcaaagtatgtttatctccggttcggcactattcctgtttttgacgggtattcaacatctggtatctccaacaccgatgacagatccaggcgtcggggttatcgtgacaattgtggcgctaatttgtacgattatccttgtctcgtttcagcgttgggtggtgcgccggacgcaaagccaggcggtgcgggctgatatgctacattaccagtctgatgttatgatgaacggcgcaattctgctggcgctggggttgtcctggtacggctggcatcgcgccgatgctctgtttgcattggggatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtgattatccatcaggacccctgttccgtcgtacccagggagggtaaacggtctatgctttcataatcagtataaaagagagccagacccgcattttgtgtataaaataccgccatttggcctgacctgaatcaattcagcaggaagtgattgttatactatttgcacattcgttggatcatttcgatgtgcaagaagacttccggcaacagatttcattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggcatttatgacggctatctgggtctgtatgaagaccgtatggtacagctagaccgttacagcgtttctgacatgatcaaccgtggtggtacgttcctcggttctgcgcgtttcccggaattccgcgacgagaacatccgcgccgtggctatcgaaaacctgaaaaaacgtgggatcgacgcgctggtggttatcggcggtgacggttcctacatgggtgcaatgcgtctgaccgaaatgggcttcccgtgcatcggcctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggcgatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattactgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggtggtcgttgcgtaggtatccagaacgaacagctggttcaccacgacatcatcgacgctatcgaaaacatgaagcgtccgttcaaaggcgactggctggactgcgcgaaaaaactgtattaatgatttcggaaaaaggcagattcctttagcctgaaaccgatgacagaagcaaaaaggcctgatgcgcttcgcttatcaggcctacatgaattctgtaatctattgaatttgcaaacttttgtaggccggataaggcgtttgtgccgcatccggcatggacaaagcgcactttgtcagcaatatgaggcggatttcttccgcctttttaatcccccaacatatactcgcaagttatagccaatctttttttattctttaatgtttggtcaaccttctggcacgctttgctcatcacaacacaacataagagagtcgggcgatgaaaaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggcgataacgtggtgatccgtcagtcccacggtggttcaggcaaacaagcgacgtcggtaatcaatggtattgaagctgatgttgtcactctggctctggcctatgacgtggacgcaattgcggaacgcgggcggattgataaagagtggatcaaacgtctgccggataactccgcaccgtacacttccaccattgttttcctggtacgtaagggtaatccgaagcagatccatgactggaacgatctgattaaaccgggtgtttcggtgatcacgcctaatccgaaaagctctggtggcgcgcgctggaactacctggcagcctggggctacgcgctgcatcacaacaacaacgatcaggtaaaagcacaggattttgttcgggcactgtataaaaacgtcgaagttctggattctggcgcgcgcggctccactaatacctttgtcgagcgcgggattggcgatgtactgatcgcctgggaaaacgaagctctgctggcagcgaatgaactggggaaagataaattcgaaatcgtcacgccgagtgagtctatcctcgcagagccaaccgtgtcggtggtcgataaagtggtcgagaaaaaaggcaccaaagaggtggcggaagcctacctgaaatatctctactcgccagaaggtcaggaaattgcagcgaaaaactactaccgtccgcgcgacgctgaggtagcgaaaaagtacgaaaatgcgtttccaaaattgaagttattcaccattgatgaagagttcggcggctggacgaaagcgcaaaaagagcattttgctaacggcggtacgttcgatcagatcagcaaacgctgatttccccaggataattatcaagcccggtggtttctcgccactgggttttttatttgtcacgattttgcgttacccttgcatctctttgaggtacagggaaaaaaagatgaaaaaagcgggtcttctttttttggtgatgatagttatcgccgttgtggctaccggtattggttactggaaattaaccggtgaagagtcagacacgttacgtaagattgttcttgagcaatgtttgcccaaccagcaggaaaaccaaaacccgtcgccatgtgcggaagtcaaacccaacgccggatacgtggttttaaaagatcgtcatggcccactgcaatatctgttgatgccaacgtaccgtattaacggtactgaaagcccattgttgaccgatccgtcaacgcctaattttttctggttagcctggcaggcgcgtgattttatgagccaaaaatacggccagcctgttcccgatcgcgcggtatctctggcgatcaactcccgcaccgggcgtacgcaaaaccattttcatattcatatttcttgtattcgtcctgatgtgcgcgaacagctggataacaatctggcgaacatcagtagccgctggttgccactgccaggtggtttgcgtgggcatgagtacctggcgcgtcgggtaacggaaagcgaactggtacaacgcagcccatttatgatgctggcggaagaagtgcctgaggcgcgggaacatatgggaagctacgggctggcgatggtacggcagagtgataactcatttgtattgctggcgacacaacgaaatctactgacgctgaaccgtgcttcagccgaggaaatccaggatcatcagtgtgagattttgcgttaaggcgaggagtttaggaaagtaagtgccggatatgaaatccggcacctgtcagacttaagcctgtttagccgcttctgcagctttaacgatcacggcgaaagcgtcagctttcagagaagcaccgccaaccagcgcgccgtcgatgtctggctgagcaaacagttccgcagcgttagacgcgtttacagagccgccgtactgaatgatcacttgttcagcgatgttagcgtcaactttagcaatgtggtcacggatgaatttgtgaacagcctgtgcctgagccggagttgcagatttgccagtaccgattgcccatacaggttcgtaagcgataaccgcaccttcgaatgccgcagcaccctgagttttcagtaccgcgtcgatctgacgtgcacaaacttcttcagttttgcccgcttcgttttccgcttcggtttcaccgatgcacagaaccggagtcagaccctgctctttcagcaccgcgaattttttcgcgatcagttcgtcagattctttgtggtaagtacgacgttcagagtggccgatgatgatgtactgtgcgccgatgtctttcagcatagcagcagaggtttcaccggtgaatgcgccggacaggttcaggtccacgttttgcgcacccagcatgatgtggctgccttcagcttcacgcttcgccatatcgatgtacatttccggtggtgcgattgcaaccgcacagccagcaacacctgccagctctttacgcaggttagataccagctcgtgaaccatgtggcggctgccgttcagtttccagttacccatcactaaaggatgtcgcattttaattctccacgcttataagcgaataaaggaagatggccgccccgcagggcagcaggtctgtgaaacagtatagagattcatcggcacaaaggctttgctttttgtcatttattcaaaccttcaagcgattcagatagcgccagcttaatcggttcaacagcgaaggtcagccccttttcgccgttgtccgcgacaacataacgcagtgcaccttctgtctcggtgtaataacgtttgtttttccccgccgttagtagcgactgcagttttttctggctttgagttttggtcattaatggggtgagtgtgcggatcaccgctgccatgtatgcctgagctttcgctttcgcggctttttgctctggcccctggatgggtagccaggttatttgaatgcttttgatttttaaggtaccgcgctccagcgcagtagaagcatacaagttctcgttaattttacttgctgcacgagtgagattggctttgtcgggactgctgtcgatggcacgaaattcgttcagtggcaggctgggattctggctgttaaagtcttctcgaaactggctgatggagagatcgaaagtaggggctccagccagcagataaggcgcggtcgttgccgtatctggtgtttgtgcatgcgccgttgttgtaacggttaatgcagaacataagagaaaaaacagcgtacaccctggcttcattgacagtaccttttgttatgactggctccgattaaaacgatatctgtcgcccttgtcaaaagggtagaatcctggaaaagacaaccatcaaggaacttacatgaccatacagcaatggttattctcatttaaagggcgtattggacgccgtgatttctggatttggataggcctgtggttcgcaggcatgctggtgcttttctcactggcgggtaaaaatttactcgatattcagaccgcggcgttttgccttgtgtgcttgctttggccaacagcggcagtaaccgttaagcgcttgcatgatcgcgggcgttccggcgcatgggcatttctgatgattgtggcgtggatgctgctggcgggtaactgggcaattttaccgggtgtctggcaatgggcggtggggcgttttgtcccgacattgattctggtgatgatgcttatcgatcttggtgcgtttgttggcacacaaggcgaaaataaatatggtaaagatacccaggatgtgaagtataaagccgacaataaatcaagtaattaacctttaatatatctcttatcgctatttttttccgggattgttatttccacgatgcaagtgacaatgcccggaaaatccttctgaactcttcaccttaagcaatatcaaaaaaaatggtaatccataagatcattacttgtttgttcttcctttaacggcgcattattcttaagtcgtaatcgacagagaggcgaatatacagaggtgccctatgaaagatgtcgtagataaatgcagtactaaaggatgtgcgattgatatcggtacggtgattgataacgacaactgtaccagtaagttttcgcgcttttttgccacccgcgaagaagcagagtcctttatgaccaaactgaaagagcttgccgccgctgcatcctctgcagatgaaggggccagcgtggcctataagattaaggatctggaagggcaagttgagcttgatgcggccttcaccttctcatgccaggccgagatgattatttttgagttatcactgcgttcgttagcttgatggagttgctttagaaggagttaaacatggcttataaacacattggcgtggcaatttccgggaatgaagaagatgccttactggtgaataaagccctggagctcgccagacataatgacgctcacctgacgttaattcatattgatgatggcttaagcgagttgtatccgggtatctacttccctgcaacagaagatattcttcaattgttgaagaataagtcggataacaagctgtataaactgacgaaaaatattcaatggccgaagacaaaactgcgtattgaacgcggagaaatgccggaaacactgctggaaattatgcaaaaagagcagtgcgacctccttgtctgtggtcatcaccactcatttatcaaccgtttgatgccggcatatcgcgggatgatcaataagttgagtgcggatctcttgatcgtgccgtttatcgacaagtaaccgcttaccagtaatgctccgctgtcatatggcccggtcggcgacgtaaatgtttcgtcatctgccgggtctccttcagcaactgttgtgtatcgcgcaccatctgtggattgccgcacagcatcacatggctggtttctttatttatcggcaggccaaccgcgctttccagttcaccactttcaattaacgccggtaatcgcccagtgagcgaacccgcagccgtttcccgactgaccaccgtctgaatgcgcagtttcccctcgtagcgtttttccagttcctgcatcagaggtagatagcttaagtcggcggcatatcgtgcggcgtgaaccagcaccatgtttttgaagcgttctaaatctttgcccaattgcagaatcgataaataagggccaatcgctgtaccggttgccagcatccatagcgtttcgcaatctggtacttcatccagcacaaagaagccagcggcttcgctaaccacctgcacttcatcgcccggtttcagtgccgccagtcgtggacttaatttgccatcggggacggtgaccaggtaaaactccagatccggattatcgggcgagttaacataggagtaggcgcgctgaacgcgttcgccttcaatttcaaggccaagtttggtgaattgcccggcggtaaacggaagcacgggagcgtgaacggtgagactaaacagggcgtcggtccagttctgcactttagtgactttgcctgttacccaatcagccatgtttttctcctgttttgattgacttgccttatcttcgttctccgaacaaaaaaattccagtcccgaaggactggaaggctcaatcgatcaaatcaatcagaggatgtgcacctgcatttccgggtctttacgatccagatagtggatggactgaatgcgacgaatggtgcgtgatttaccacggatcagcagcgtttcggtggtggcgatattgcctttgcggctaataccttccagcagatcacctttggtgatgccggtggcagaaaagatgacgttgtcgctgcgcgccatatcgcccaaacgcaatactttaccggcttcgatgcccatcgctttgcagcgtgccagctcctgctcgccaatgcgacgattctcttcgttgtcgcctttgacgtcatgacgcgccagcagacgaccgttcatgtcaccatctaatgcgcggatcaccgccgcagaaaccacgccttccggcgcgccaccaataccgtacagcacgtcaacttcgctgtctggcatacaggtgagaattgaggctgcaacgtcgccgtccggaatagcaaatacgcgcacgccgagttgctgcatttctgcgataacggcatcgtggcgcggttttgccagaatcgttaccgtcagttcgctcaacggtttgccgagcgccgccgcaacattgcgcaggttatccgccagcggcaggttcagatcaatggtgcctttggctcccggtccgacgatcagcttctccatatacatatctggcgcgttgaggaagcagcctttatcgcctactgccagcaccgccagcgcgttagcctggcccatcgctgtcatgcgcgtgccttcaatcggatcaacagcaatatctaccgcgtcgccgcgaccagtaccgactttttcaccaatgtagagcatcggtgcttcgtcgatttcaccttcaccaataacgatggtgccgtcaatgttgacctggttgagcataatacgcatggcgtttaccgccgcgccgtccgcggtgtttttatcgccgcgtcctaaccatttgtagccagccagcgctgctgattcggtgacgcgggaaaattcgatggcaagttctcgtctcatagcaaactctaagcagtaaggaatggcgcgaagtgtagcacaggggaagggcgggattattgatgtgtgcggggttgcccccgcacggtttcagagtctgcgtgatgccggatgtgtatccgactcgtaggcctgataagacgcgcaagcgtcgcatcaggcaatcattattactcgtcgtgttcttcccatgccatcgcgcgtttgaccgcttttttccagcctgcgtaacggtaattacgctcagtggtttcgatgcctggacggaactcgcgttcaatcaccgctttctcttgcagctcgtcaagattctgccagaagccaaccgccagaccagcaagataggccgcacccaaagcggtgacttcgcgcacttccgggcgctcaacgcgcgtaccgagaatatcggactggaactgcatcaggaaattgttcgccaccgcaccgccgtccacgcgcagcgcgtgcagacgaataccggagtcggcctgcattgcttccagcacgtcacgcgtctgataagcaatagactccagcgtcgcgcgtataatgtggttagcgttcaccccacgagtcagaccgaaaatcgccccgcgtgcatacggatcccagtatggcgcacccagcccggtaaaggccggaaccacatacacaccattggtgttttgcactttggtggcgaaatattcggaatcgtaggcgtcgttaatcaacttcatctcatcgcgcagccactgaatggacgcgcccgccataaacactgcaccttccagcgcatagttcacttcgccagtcgggccgcaggcgatggtggtcagcaggccgttttctgatttcaccgctttctcgccggtgttcatcagcataaagcagccagtgccgtaggtattcttcgccatcccttctttcacgcacaactgaccaaacagcgcggcctgctggtcaccggcgatcccggagattggaatacgcgtgccgcctttgccgccaatgttagtctgaccgtatacttcggaagaacgacgcacttctggcagcatctcacgcggaatatccagcacctccagcattttgtcgtcccagtccagggtatggatgttgaacaacatggtacgagaggcgttggtgtaatcggtcacatggacacggccctgagtcattttccagataagccacgtatcaaccgtaccaaacagcaattcaccacgacgcgcacgctcgcgagagccttccacatggtcgaggatccacttcactttggtgccagagaaatacgggtcaatcaccagaccggtattgctgcggatataatcttctaaaccgtcacgttttaaatgctcgcagatttctgcggtacgacggcactgccagacaatggcgttatagataggcttgccggtttctttttcccagacaatagtggtttcacgctggttcgtaataccgatagctgcaatctgatcggaactgatatcggctttcgccagcacttctaccagcgtggagctttgggtggcccagatttccattgggtcgtgttctacccagcctggttttgggtagatttgctcaaattcgcgctgcgacacgctaatgatattggcatcgtgatccattacgaccgcgcgggagctggtggtgccctggtcgagcgcaacgatatattttttttcagtcatgtttaattgtcccgtagtcatattacagcgaagctttttgttctgaaggagttgtggtctccttttcttccacaacacagatatcgcaaggcaaatggcgaccaatcagtttgcggtaggcaaatgcacctacaatcgcgccaacgatagggccaaaaagcggcaccaggaagtaaggaatgtctctgccgccggtaaaggcgacattgccccagcccgccagccaggcaaagactttcggaccgaagtcacgcgctgggttcatggcaaagcccgtcaatgggcccatagatgcgccaatgaccgcaatcagtagaccaatcagcaagggagccaaagggccgcgtggtacaccgttgccatcgtccgttaacgccaggatcagccccatcagaatagcggtaatcaccatctcaactgcgaaagcctgcacaaaattgatatgaggattagggtaagtagagaaagtgccagccagatcaacactttcaacgctgccgcgaacaatgtgatgagtctgctcgaagtcgaaaaataaattgtagtaaagcccgtatactaaagccgcagcacagaaagcgccggcaacttgtgaaacgataaaaggaataactttgcgcttgtcgaaacaggcaaacagccacaatgcaatggtaacagcgggattaagatgcgcgccggaaacccctgcggtcaggtagatggccattgccacccccagtccccaaatgacactgatttcccactgaccaaaagacgcacctgcgacttttagtgctgcaacgcaacccacaccgaaaaaaatcaacaacccggtaccgaggaattcagcaatgcactggcctttcaaggttgatgtttgactcataatcggatcctgaagagttaatgtttgttgtatgcgtgaaagtcacggacctccacgatgcttgtaggcatgctgtaaacttatcgttaacgagcaaaaacgagaaatatcgaacttaaaatgtgtgtgcttcgtcataaaatgagcgttatcgcgccatttattccatctgattgtacatgatgcatgtttgttagatcattcgcgcaacaaatttattaacattttcgattggtgtggattatgtcaccaggagaaggatgaaaagtgtggcaaaccgtaatctgcaaggcgtgccgctggacagcgatggcgcggcttcatacaatcggagctaactaaagtgcgctcgtatttattaaggcgtcaccggtaatcgggacgaggatttttatccatcaacgccttgcaattcaggagaggtatgacaatgtcattagaagtgtttgagaaactggaagcaaaagtacagcaggcgattgataccatcactctgttgcagatggaaatcgaagagctgaaagaaaaaaacaactcactgtcgcaggaagttcaaaatgcccagcatcagcgcgaagagctggagcgtgagaacaaccatctgaaagaacagcagaacggctggcaggaacgtctacaggccctgctgggtcgcatggaagaggtctgattacacttcatctttcgcgtaatttctttactgtgtaggccaacaggtaacgcagaaaaaaggcaccttgcggtgccttttttatcattcaatatccagcggatcttctgaaagaataatcccggtattgtcggcataaagatggtcgccggagaagaaggtgacaccgccaaaattgacgcggacatcgctttcgccaatgccttcgccagcggcaccaaccggaattgccgccatcgcctggatgccgatatccaactcttccaggtcatctacctgacgcaccgcgccgtaaatgaccagaccttcccattcattttgtactgccagacgcgccagttcagcatcgaccagtgcgcgacgaacagaacctccgccatcgacgacaagaacacgaccacggccattctgttcgagcagatcgtacagcaacccgttgtcctcgaaacattttaccgtgattatttgtccgccaaacgacgcccgtccgccaaagttggagaacagcggttccacgacgttaacatcttcttgatagatgtcacaaagctcggaagtatcgtatttcataggcttaacattcagttgctgcgagaattttcagtatatcgcgctatgtgggctgttggcaaaatcatcaattgttaattgatatttgtcagttatgctgcccactggcttaggaatatccctaaaacaaacagcaggttagtcagtaacgctcctttgacagtgcgttccagcattggtcgcatcgccaccgggtccatttcgcgcatcacataacgagcttgcttcaccagcaacggtgccgccagcaggaacagccagccccacaggctatgcagcgaaaagagattaaacagcgccagacacaccagtgagcccatcagcaggcaggcatgataacgacgcgcgtttactgcgcctaagcgcaccaccagcgtgtttttgccgttttcgcggtcgctattgatatcacgcaggttattaatgttcagtactgccgttgccagcaggccgcatgcggttgccggaaggatcagtgccggaatcaatgtatgagcctgtaaataccagctccccatgacgctcaaccagccaaagaaaaccagtacggaaatatcacccaaaccgatataaccataaggacgattgcccacggtgtaggtgatagcggcaatgatcgacaacccgccaagaatcaggaaaccgacaaaatcggccagcgtatggcacgccactgcaaccagtgccagcccggaaagacagatgagcacaacggtaataatgagcgcccgtttcatctcttgctgggtaatgacccctttttgcatgccgcgtagcggcccaatgcggtcaggtttatcgctgccttttaccgcatcgccgtaatcattggcgaggttagaaaggatctgtaatagcccggcggtaatcaatgccagcagggcgaccagtggatcgaagtgaccttgccaccatgccagcgccgtcccgacgataattgcagcaaaggcgagggggagggttttaggtcgtaaactttccagccacgcctgagttcggctaatttgttgttcagtcataatacgcgccaataaaaatggggcctttcagccccatcaaacaatgatgaaaatgattgaacgcgattataggataaaacggctcagatcttcatctgccaccaacgcatccagatgtttgctcacataatctgcgtcaatagtgatagtttgaccgcttaaatcgctggcgtcgtaggaaatctcttccattaaacgctccagaacggtatgtaaacgacgagcaccgatgttttcggtagattcgttcacctgccatgccgcttccgcgatgcgcttaataccggagtcggtaaactcgatatttacgccttcagttgccatcagtgctttgtactgcacagtgatagaggcattcggctcggtcagaatacgctcgaagtcgctggtggtcagtgcctgcagctcaacgcggattggcagacgaccttgcagttccgggatcaggtcagacggtttcgcaatctggaacgcgccagaagcgataaacagaatgtggtcagttttgaccatcccatgtttggtggaaacagtgcaaccttctaccagcggcagcaggtcacgctgaacgccttcacgagaaacatccggaccggaagactcgccgcgcttacagattttgtcgatttcgtcgataaacacgatcccgtgctgctcaacagcgtcgatagcatcttgcttcagctcttccgggttcaccagtttcgccgcttcttcttcaatcagcagcttcatggcgtctttgattttcagcttacgcgctttttgtttctgaccgcccaggttctggaacatggactgcagctggctggtcatctcttccatgcccggaggagccataatttcaacgcccatcggtgctgcggcaagatcgatctcgatttctttgtcatcaagctggccttcacgcagttttttgcggaatgcctgacgagcagcggacggttcctgctgctgttcggtctgtccccagttgtttttagccggtgggatcagtacgtcgagaatacgttcttctgccagttcttcagcgcgataacggtttttctcgatagcctggacgcgtaccattttcacggcggcatcggtcagatcgcgaataatagaatccacttccttaccgacatagcccacttcggtgaatttggtcgcttcaactttgatgaacggcgcattcgccagcttagccagacgacgggcgatttcagttttaccgacaccggtcgggccgatcatcaggatatttttcggggtcacttcatggcgcagctcttcgttgagctgcatgcgacgccagcggttacgcagagcaatcgccacggaacgcttggcgttgtcctggccgatgatgtgcttatccagttcgctgacgatttcgcgtggggtcatttcagacatgggagatccttacgctttgtagcttaattcttcgatggtgtggaaatggttggtatagatgcaaatgtcgcctgcaatatccaacgccttttcagcaatttcacgggcgctaagttcagtgttttctaacagcgcgcgcgccgcagcctgggcgtaagggccgccggagccgatagcaataagatcgttttctggctgcaccacgtcaccgttaccggtgatgataagcgatgcagtttcatccgcgactgccagcaatgcttcaagtttgcgcagcatgcgatcggtacgccagtctttcgccagctcaacggcggctttgatcagatggccctgatgcatttccagtttacgttcaaacagttcgaacagcgtaaaagcatccgcagtaccgcccgcaaagcccgcgatgactttgtcgttgtacagacggcggacctttttcacgttgcctttcattacggtattgcccaacgtggcctgaccatcaccagcgatgaccacatggccgttacggcgtacgcttactatagttgtcacgagctgaccccttggtttcgaatacagagtacaaaccccgtacaaaagtacggggcataatgtaattatagatgggggggattttgagggtttcaacccccggcggcgagccgaatgcagtttgtatgacccgccatcttcaagcgattgagggtgctgtctgcgttctctttgcctttcaccgggccaatcaccacacgattccagccattgttggtggtaatttttgagtcaaagccttcgaacgccagctgagcacgtaccgtctctgcctgttccgcgcctctgaacgaaccgcactgcaccatccagcggcgttcgtcttttttctccgccgtcggttttggcgcgtcagcggcacgagcaaccggcgcagcttgctgcggcttcgactgcgcggtcgtgtgcgcaggggtttgcagcagatcctggtaaggctgctgagtagaagccggtttagactggcgcggttgcgcctgtaccggtgcggcttgcgacgtacgcgtctgctgctgccagctttgttcagtcgtacgcgactgctgagccaggcgttgctgctccgctaattgctgcgcctgacgctggcgctgtagcgtttgctgacgctgttccggcgtctgctcattccacggaacttcaaccagctgcgttggctgctggcgcatatcagcctgcatttgttcaagaagctgacgttgttctggtgtcagttgctccggcgttttcacttcaccaccagcagaaggttctgtgggcgcacgcacacccggctggcgactttccagctctttgatgtagcgccagcgttcttctggttttggtggtagtccgtttccggtcactttctggctttgcagcgtctcggactcttctttcttgtgatgcgtaatgaagtacagaccaccgataaaggtcacaagaacggcggcagcaatagcgaccatagcgggagaaaccgcaggcagatttcgttgctttttccgtgaggtgctcttttttcgccgcgaaggtgccggttggctgcggcgtacataatctcgttgtgccactatcgtttcgctgtatttattcgttcgtcagcccgccatgttacttaagcggcgggcctttgaccagtcacggcagtcttaaaggtttactttaaggtaacgcgcgtgttgatccccggatgataagttcgcagtccattaaacgagagccactgccaacgtgttgcccctgcatttgatcaagcaataacagcatagcttcccgaccgatttcgtaacgcggctgcgcgatggttgtcagcggcggatcacaaaattgcgtcaggtcgatgttatcaaaaccgattatggaaaggtcttccgggactttcagcccctggcgttttgcctgagaaagtgcgccgagcgccatcacatcgctatggcagaagacagcagtaggcggttgtggaagatcaagcaactgctgcatcgctttgcttccggcttcgaaggtgaagtcgccacgggcgatgtattgcggatcaaccataatgccgcagcgacgcagcgcctgaacgtagccttgcaggcggtagtgacacagcggcatctcttcaggaccggctatacagccaatccgtttatgcccttgctcatatagataatttactgcatcaaatgcggcggtcagattgtctatatgaactgtaggtagctccagttccggtgcaaattcgttcgccatcaccatcggcggcagattacgctgttcctcaatgctggcatcaaacggcagccttgaacccagcagcaacatgccatcaatttgcttggtgatgatcaaatcgataaaggttttttcctgctgattttgatgcgcacagtcgccaatcagcaccagatatccgtgatttgccgccgtaacttcgataccgcgaataatttcgctaaagaaagggtcgcagatatccgggacaatcaccagaatagtgcgggattcattacgcttgacgttgcgccccataggctgtggtaaataacccacttcccgggccgctttttcaacccgattacgagtggcctgggagactttatcgggattcattaatgctcgggagacggtcgctgtagagacttttgccttgagggcaacgtctttcatggtcgcggcagtttcctgcttcttcgctttcacactcactcctcgcctggcacgtcaggcgtactacatccatgtttacttcacatcggcaacatttttagcagatagcgcgtgaaaacggttacagaattttcatgaaaagtgtgatgaatattgaatttttcgatccgcctcgcatcgtgagcggtttaaccctcaatcggatcgacatccagcacccatttcaccttgcgggaatccggtattgtattaataagcgccagcgtaccattgatgatgtgctgtaagcgcacgcgggaagggtgctgcaacaatatctgccagcgccagcgaccgccacgtttaggggccagcgccggaaccggaccgagaacccacagtttctcgtctgccagtgggctggcgagaatgagattacgcagttgttgcaggaacaatggcgcgtgctgattgttatgatcttccgcacgcacaatcacatggctggtccacggcggcagctgcatcatgcgtcgttcagccagtgcctgttcggcaaaggcgtcgtagcctttatagagcaacgtttgcaacagcggatgttcaggatggtgcgtttgcagaactacttcgccctgtttaccggcacgtccggcacggcctgccacttgggtgtaaagctgggcaaaacgctccgccgagcggaaatcggcagaaaacagcgcgccgtccacgtccagtaatgccaccagcgtcacatccggaaagtggtgacctttcgccagcatttgcgtgccaatcaaaatcctcgcgccaccgcgatgtacttccgccagttgttgttccagcgcccctttgcggctggtggtatcgcggtcgatacgagaaatggggacaccagggaacaacggcgcgagcgtctgttcaagctgttcggtgcccagccccacggggaccaggtgcgtggaaccgcaagaagggcactggcgcggcaccggacgctgactgtcgcaatggtggcagcgcaaatgctgttgcgcctgatgcagcgtgtagtagtgatcgcaacgtgggcattcggctatccaaccacagtcgtggcacagtagcgcaggcgcaaaaccccggcggttaagaaagaggataacctggttgtcggcctgtaaatgctggcgcatacgggtgattaacgccggagccagacctgcctgcaccttctgaccttttaaatccagcacatgttgaattgccgggcgcgcattgcccgcccgacgggtcaggcgcagcaggcggtattttttctgctgcacgttgcataacgtttccagtgcgggcgttgcggagccaagaataattgggatttgctcgctatgcgcgcgatacaccgccaggtcgcgggcatgatagcgccagccttcctgctgcttgtaggagctgtcgtgctcttcatcaataacaatcacgccgagatttttaaacggcgtaaacagcgcggagcgggtgccgatgacaatcgccgcctcgccatttttcgctttcaaccacgccgaaagacgctcgctgtcgttcaggccggaatgcagaacttccaccggggcattaaaacgttcacgaaaacgggcgatagtttgcggtgtcaggccgatttccggcaccatcaccagcgcctgtttgccctgagcgagcacgttttccagtacactgagataaacctccgttttaccggaaccggtaacgcccgccagcagccaggcagaaaaagtatctgccgcgctatgaattgcgccaacggcggtggcctgttcggtattcaaccgcaaccgctcaccagaaacggcatagttcgttcgccagtcgctaaactctggtgtttcacttgctaaatcacacagaccttttttgcgcagtgcctgcaacgcggcatcattaaattcaagttccgcgacctgatcacgccagattttgcgttgccgtaacgctgccagcgcctgttgttgctttggcgaacgtttcaggctgttcagatccaccgcctgaccttgttcagtggcaaaccagtaccacatcggcgcgttcgccgcaggccgcccctggcgcagtaaaatcggcaaggcatgaaacagcacatcgccaatcggatgatgatagtaatctgccgcccagagcagtaatcgccagacagagtgagtaaataccggctcaacgtccagcacttcaactaccgctttcagctcgttaagcggcagctcactgacatcgctcactgacaccacaaccccgatacgctcctgttgtttgccaaacggcacgcgcacgcgactcccggctttaaccgtcatgccttctggcagcagatagtcaaaggtacgaggaagcggaacgggcaaggcaacgtgggcaacgggcatagcatcatcctgacttgaaattcggtgggttagtatacacattgccgtagaagagtgcggatcagtttgcatatgctggttaatttctgtatgatttcgcgccttcgtacgaaatgatcgtattgaagctatacttttaacatcgcgtggtgtctggcgttagggctggaagagcgacgcggccttaaaccgaggttttcccatgaaaaaagatattcacccgaaatacgaagaaattactgctagctgctcttgcggtaacgtaatgaaaatccgctccaccgttggtcatgacctgaacctcgacgtgtgcagcaagtgccacccgttcttcactggcaaacagcgtgatgttgctaccggtggccgtgttgaccgcttcaacaagcgtttcaacatcccgggcagcaaataagaccggatttccgaaaaaagcgccgtacggcgctttttttgtgcctgaattttggtcgtattaccaggaaaacagcggccattctttggcgaccgtggtgagttgtggcgcgtcgaaaacggcttggggtgaaactaccgtttcctcaagcggaatatttttgccgtagcgttctttgagcttcgcctggaccagcgggttgctgagatcgaactctttcaacttctgctgttcgcctacgcgcattcccagcgcattctgataaaccttccacaccacttccgaacagtactggcgatcgtcgctccacgagaagctgaaatcgtacggtttgccgagataacgttttgccgtttgcgccagtttttgctgttgttcaacactcagtccgccttcaacgcggcgaacaacgtatttgcccttttcaccatgggcaatccactgcttgagcggggtgtatttcaccgggccgaccgcttcaaaaacgtagggctttttgttgcgtatcaccagcataccggtgtggctgtaatcggaatgggtcgccagttggatcgctttactttgcgatgagcgagagacctgaaagatgatgtcgccggtttgtggttgccaggcaaatgcaggcacagaaaccagcaggccggggatcagtagcctgattttcatcgttaaacgtccatgtatgaaaaaagcggctggttaactccgcgccgctcttttccgctttagtattcccacgtctccgggttaatccccatctcacgcatgatctcttttgccgcttccgggatttcgtcgctgcgctctttacgcagatcggcatcatccggcagaggttgcccggtaaaggcatgcagaaacgcttcgcacagcagctcgctgttggtcgcgtgacgcaggttgttcacctgacgacgcgtgcgttcatcggtgaggatttttaacaccttaagaggaatggaaaccgtaatttttttgacttgttcactcttcttgccgtgctcagcgtatgggctgatatattcgccgctccattcagccatgagatacttaatcctcttcgtcaataaattgagaccagaccacacagtgaatgtgggtactgaccgtaaacccgcatagtttaccgtacaggcgttaccgtgacatcgtgtaatgcacctgtcggcgtgataatgcatataattttaacggctatttgagatttgctcaatctatacgcaaagaagtttagatgtccagatgtattgacgtccattaacgcaatgtttactctggtgcctgacatttcaccgaccaagcccagggaacttcatcacatgacgcgtaaacaggccaccatcgcagtgcgtagcgggttaaatgacgacgaacagtatggttgcgttgtccctcccatccatctttccagtacctataactttaccggatttaatgaaccgcgtgcgcatgattactcgcggcgcggcaacccaacgcgcgatgtggttcagcgtgcgctggcagaactggaaggcggtgctggtgccgtacttactaataccggcatgtccgcgattcacctggtaacgaccgtctttttgaaacctggcgatctgctggttgcgccgcacgactgctacggcggtagctatcgcctgttcgacagcctggcgaaacgcggttgctatcgcgtgttgtttgttgatcaaggcgatgaacaggcattacgggcagcgctggcagaaaaccccaaactggtactggtagaaagcccaagtaatccattgttacgcgtcgtggatattgcgaaaatctgccatctggcaagggaagtcggggcggtgagcgtggtggataacaccttcttaagcccggcattacaaaatccactggcattaggtgccgatctggtgttgcattcatgcacgaaatatctgaacggtcactctgacgtggtggcaggcgtagtgattgctaaagacccggacgttgtcactgaacttgcctggtgggcaaacaatattggcgtgacgggcggcgcgtttgacagctatctgctgctgcgcgggttgcgaacgctggtgccgcgaatggagctggcccagcgcaacgcgcaggcgattgtgaaatatctgcaaacccagccgttggtgaaaaaactgtatcacccgtcgctgccggaaaatcaggggcatgaaattgccgcgcgccagcaaaaaggctttggcgcaatgttgagttttgaactggatggcgatgagcacacgctgcgtcgtttcctgggcgagctgtcgttgtttacgctggcggaatcattagggggagtggaaagtttaatctctcacgccgcaaccatgacacatgcaggcatggcgccagaagcgcgtgctgccgccgggatctccgagacgctgctgcgtatctccaccggtattgaagatggcgaagatttaattgccgacctggaaaatggcttccgggctgcaaacaaggggtaaaaatgagtgtgattgcgcaggcaggggcgaaaggtcgtcaactgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacattacgtcgttatcagtgcgatctgattagcggcctgctacccgccgaagaagccgataacctcattagcgcttttgtcagcgatcttgagcacctggctgcgttgctcgacagcggtattaacgatgcggtgtatgcggaagtggtgggccacggtgaagtgtggtcggcgcgcctgatgtctgcggtgcttaatcaacaagggctgccagcggcctggcttgatgcccgcgagtttttacgcgctgaacgcgctgcgcaaccgcaggttgatgaagggctttcgtacccgttgctgcaacagctactggtacaacatccgggcaaacgtctggtggtgaccgggtttatcagccgtaacaacgccggtgaaacggtgctgcttgggcgtaacggttccgactattccgcgacacaaatcggtgcgctggcgggtgtttctcgcgtaaccatttggagcgacgtcgccggggtatatagcgccgacccgcgtaaagtgaaagatgcctgcctgctgccgttgctgcgtctggatgaagccagcgaactggcgcgtctggcggctcccgttcttcatgcccgtactttacagcccgtttctggcagcgaaatcgacctgcaactgcgctgtagctacacgccggatcaaggttccacgcgcattgaacgcgtgctggcctccggtactggtgcgcgtattgtcaccagccatgatgatgtctgcttgattgagtttcaggtgcccgccagccaggatttcaaactggcgcataaagagatcgaccagatcctgaaacgtgctcaggtgcgcccactggcggttggcgtgcataacgatcgccagttgctgcaattttgctacacctcagaagtggccgacagtgcgctgaaaatcctcgacgaagcgggattacctggcgaactgcgcctgcgtcaggggctagcgctggtggcgatggttggggcgggcgtcacccgtaacccgctgcattgccaccgcttctggcagcaactgaaaggccagccggtcgagtttacctggcagtctgatgatggcatcagcctggtggcagtactgcgcaccggcccgaccgaaagcctgattcaggggctgcatcagtccgtcttccgtgcggaaaaacgcatcggcctggtattgttcggcaagggcaatatcggttcccgctggctggaactgttcgcccgtgagcagagcacgctttcggcacgcaccggctttgaatttgtgctggcaggcgtggtggacagccgccgcagcctgttgagttatgacgggctggatgccagccgcgcgctagccttcttcaacgatgaagcggtcgagcaggatgaagagtcgctgttcctgtggatgcgcgcccatccgtatgatgatttagtggtgctggacgttaccgccagccagcagctcgctgaccagtatcttgatttcgccagccacggtttccacgtcatcagtgccaacaaactggcaggagcaagcgacagcaataaatatcgccagatccacgacgccttcgaaaaaaccgggcgtcactggctgtacaacgccaccgtcggtgcgggcttgccgatcaaccataccgtgcgcgatctgatcgacagcggcgataccattttgtcgatcagtgggatcttctctggcacgctctcctggctgttcctgcaattcgacggtagcgtgccgtttaccgaactggtggatcaggcgtggcagcagggcttaaccgagcctgacccgcgtgatgacctttccggcaaagacgtgatgcgcaagctggtgattctggcgcgtgaagcgggttacaacattgaatcggaccaggtacgtgttgaatcactggtacctgcccattgcgaaggcggcagcatcgaccatttctttgaaaatggcgatgaacttaacgagcagatggtgcaacgactggaagcggcccgcgaaatggggctggtgctgcgctacgtggcgcgtttcgatgccaacggcaaagcgcgtgtgggcgtggaagcggtgcgtgaagaccatccgctggcatcactactgccatgcgataacgtctttgccatcgaaagccgctggtatcgcgacaacccgctggtgatccgcgggccaggtgcagggcgcgacgtcacagccggggcgattcagtcggatattaaccgactggcgcagttgttgtagtgattattgaacaaaagctggcagttgccagcttttgttgtcacccctaaacctcttcctggggaagtggtgattgattgtcattttgcctttggtcagtgcccccggtaataagggggcttttgtgttgagcgatgaagtaacagagtgaatggtgaagttattaatgacaattacaaaatgacattaagtaacaatatctaaaatgtcacctaatttaaaattgataaccaatagtagtataggttccccatcctgtattttttaattcaaatggaccatctccgaagttaaccttctctcccgcattccattgtccaccgttgtgaaaataacgtagtgtaaatgcaaatttccagtgttcatatagaagggaaaggatatggcttgaagcaatagcattactggttcgtttattattgtgtgacttgtccgcaagatcggagccaaaatcaaagttagtaaaactattgtataccaatcgtcctccgaataaatttgtaagagggatgctatattttattttgaatcgatatccgtcccattcattttcattagcggcaccatagttttgccactgatacttggcgtatatattggcagaaagcttaattggtagacccgtgtcgatatctgtaccaagccccatataccatgtactttgccgggatgactggttgtcacccatatcatagacatagttgtttgcaataaaccattctttaaatgggccgaacgcaagatttaatccggtcaatttgtcaatggaaaaccgaggttctatttccgtaaatagtggtgagccctcatcccagatcccaacatcatagtgactgccgacgccaaagaatttcggtagatcaacataaccataaaaatcaaaccagtcttttcttcctgctacagtatattcagggtagaggtcgttagtcagtcttgggccaaagcgagagtctgtgcgaccaatgacattcaagctttgatgtaaccagctttcatcaattttaatttcctgagcgtttccaatgcaaggtattaatagaatggataaagctatccagtgcttttttatatacataaatatatctcttatatattgttgatttagagagaaataatgtcatccagtgaatgaatggtattataagtttttgttatttgcttacttctacccgcatttcatttacctgtgcaggagtaatcttgtggcctttcttaaaataatcgattacgacattggacatgttatttccggcgcggacctggacatttttcccttctttgaatgccagaaaaccatcgcccccaagtgcaaggaaagtcgtagtcgcaacatggtaaatattcgtatcaacgatctcttcaccattaattttaaaagatacaatgcgctgacctactggtttctgcagggtatagcgcatttctgcgccttttgacatttgcaggatgccattggtaagcgatgccccgtgctccagtaggttacgcagatccttaccgctgagatccatttcagtaagttcattcttgaaggggaatgtactggtaatgtcaccaaaggtaatcgtgcctgcatttatatcagcacgtaaactgccggagtttatcaacgcaatttgtgcagtcggtgcagcgacaagcattgcatcggtaaacaggttgccaagttgcgatgactcaccgtaggcacgagttaatgcaatcgatgattcaccgactggttggcgtacaagatccgccagttttttattccagctattgataactttttgtgtggttggatcgggtatccattcatcggcataaaccgttttcagctcaaagctcttcactttatgagtacgagctgtagggttgacatcaaggattaatttaccaatatcgataccgccactgtcagtcgaaaggattaaggtgttgccgactttgattggttctggcgttccgacgtgggcatgcccggtaatcagaatatccaatcctttcaccttgcttgcggtttgaatatctttatccagcgcacgtctaacatctgtattgccaatgctggactgacgcgccggtacgccttcatgaaccagcgccacggtgaggtcaaccttatcacgtaactcgtcgatataatgctgcaaatacttcacttcatcacgtgcttcaatcccctgattcttgagggtcgcggaagatttatcaaatcggttattattgtcattatcgagtccctggagagagagctccgagacagtgtcattaaatgcaaatacgccgtgtagcccaacaataccaatcttgatgccatctttttccaggatggtgtagggcttgttccagaagggtttctcactctctttatgataaacattgcctaataaaacagggaaattcgctttgcttaattgtcggagggcattatcccagccatggtcaaactcatgattaccgattgatactgcgtcaaaaggcatggtattcataatatcaattattgcttcgccctttgtcaggctactgatatatggcccggtgaaatagtctccagcatcaaaataaaaggtggctttatttttggctttctcttgttttactaacgtggatatattggcaaagccaccaatgtcgcgttttccgtctgcgacatacggtactttataggaatccacatgggcgtgaagatcattggtataaataatcgtgacatcctgcgccataactgaggtcgaaaaaatagtcagcaatgttgcggcaaataaagtacgctgcgctgttttcattcgcattccttgttaaataaattgactgataaatgagattttatttggcgacgtccatgactcgtttagttaagtctggggtgacaggtttatgatttttgaaataatcgatgatagattccgccgaggttgttcccggtatcgtcttcacattttttccattcaaaaatgcttcaaaaccgtcaccaccactggcacaaaaggagtgcgtggcaatacgatatgtttgattatcttccacgggtttgccgttaatggtgaaagagattaaccgttggttgagtggttttttgctgtcatagacaaccgcaacgctttttgaaacctgtaacacaccgttagttagattggttgcatgcgtcatcaatgatttgagatcgcggcccgtcaaatccatctcgatgaggtcattattaaaggggaatgtgctaataacatctcccagtgtgatatcgcctttaggaaaatcagctcgcatcccaccgctattttgaaatccggcaacggcatcaggtgttttttccatcattgcatcaagaataaggttgccggtagaagaggaactaccatactcacgtgttaaaactacgggagaatggccgacaacttcctgtgttattttgttaagctttgcactccatttatcaatagtattttgaacgatggtgtcaggtttaaattgatctgcaaagatggtgattaactcaccattataactatcaattttcttcgttttcggattgtaatcaagcacaagttttccgatgttggtgccgtatgcatcggtagatacaattaatgtgttattaacttttattggttgcggtgttccgacatgtgcgtgaccggtaattaagacatcaacaccattcactttttttagctgtctcaatatctgcctgtagtagccgctccacatctttactaccaaagcttgattgacgcgccgggacaccttcgtgaattagcaaaacggttatgtcgactttaccttttaattctgcaagtgctttatttaaatatttaatttcgtctctggcttctacgccttcacgtgcttttgccgcgactgtatcatagaaagcgaatgcgccatgcaatccaatcacaccaatctttaaaccatctttttcgataatggtccacggatgatcccaaactggtttattcgtatcggtgtagtagatatttcccagcagaatggggaattttgcttttgataactgagacaccatattgggcacaccgtgatcgaactcgtgattaccaacagacaccgcatcaaagggcatagtgttcatgatatcaataatagcttcacctttggtcagggtgctgatatacggcccggtaaaatagtcgcctgcatcaaagaaaaacacatctttgctttttttcttcgcttcattaacgatgcctgcaatattagccataccacctataagtctgttcttatcaacagcgaggatttttgccggattgacatgtgcgtgaatgtcattcgtataataaatagtaacgtcctgagctagaacactgtgagaaaatatcacgccgaatatgactgataatgttgtaaatacagttttcatcatccctcctggatagggtgtgttacatttgttgaattatttaaataaaaggcacatcgtgtcttattttatgtaagcatagttcagaaaagtattgtgtgatcttagtaacaaataatgttattaattaaacattgaccatgattatatttcacggtcatacatttatatatttaattaaatgaaaggtagtgatctctcttaatttatggtcgtttgtcgagtgtattgactaacaagatggagtgagcgattcattgtattttaacgccagtgaggtcagcatttgcgttacgcgacctgcggataataacgcgctttgggtaaagtcgtgttggtctgtcagccatgtgataaaacaacgactggttgccagagaaacatttgcgcccctttctaagctggctcccgtgagtaggcagaccatcttgcaattattcccctgctcccagcgctgccactgattttgccaccaaccatggtatgtcgttcccttaaaatgccagggcgtatcagcgttactgtcactgatttcttcttctacgaaccaaagttcaccttgttgttggcggaactgatctgcccaggctgtaataattgcgcctcttagaaaacattcgtgtgaaataatatgcgttttgacatctggatagcggattttcagtattctgaaatgcccgtgtgccgtgataaccgggcgtagtatggctcccttaccgttgcgcttgagtacagcactgccatactgaatttcatcgaactggctccggcgcaagaattgcgcttcacgcatatctaccttctgcacgatatcgcgatggtgcatagttggttctgtgttgcccttgtaactgtaccgcagactgtctcctgtctgatgttgcgtataattcgtggagagatgaagaatgttgccacgagtggcgtcaagactgactaaaacatacagtttttgtactgcgctggccccttgaaagggtatgaacagttgaacggtttcaatggcctggggatgcgtaatttctttctgatattttttaggcgtccagacttttttgcagttacggcattgaatgcgttgcgaaccctgtggattgtgaccataacaaatcatgtctgtgccataacataccgggcagaaatggcctttctcaattgcataagtagacaagtgaactgacaaccagtcacgaaattgttgctcgtcaaacaacggcgggtaactgccacatgcccgacagtgcagtgccggataacccagtttatagtctggccaactgtaatcttccgatgaggccaatcccaaatttcggcaaccgaacgttttacaggcattaatcgtaaacagagtcgacatatatcaccaacgatttcacaaggtcgttgattttgtccggcaactatcccctgcggatgtgattactctcacataaataagtctttcagaacgtaatgtagcaatcctttatctcactgaaagggattgtttatgaaaattaaaatacttgctgcgggtatcgcattaacactgccgttctgggcttgcgctaaagatgtcactattatttataccaacgacctccatgcgcatgtagaaccttataaagtgccgtggatcgctgacggtaaacgggatattggcggctgggcaaatatcactacgctggttaagcaagaaaaagcaaaaaataaagcgacatggttttttgatgcgggcgactattttaccgggccatatatcagcagcctgaccaaaggtaaggctattatcgatattatgaatactatgccgtttgatgccgtcacaataggcaaccatgaatttgaccacggctgggacaacacattattacagttgagccaggcaaaattccctattgtgcagggcaatattttttatcagaacagcagtaaatcattctgggataagccctataccatcatcgaaaaagacggcgtgaaaattggcgttataggtttgcacggagtatttgccttcaatgatacggtatctgctgccacgcgcgtgggtattgaagcgcgcgatgaaattaaatggctacaacgttatatcgatgaactcaaaggcaaggttgatttgaccgtcgccctgatccacgaaggtgttccagcccgccagtccagtatgggaggcacagatgtgcgtcgcgcgttggataaagatattcagacggcaagtcaggtgaaagggctggatattttgatcaccggacatgcacatgtgggtacgccggaaccgattaaagtcggcaatacgctcatcctctccactgacagcggcgggattgatgtgggcaaactggttctcgactacaaagagaagccgcataattttacggtgaaaaacttcgagcttaaaaccatttacgctgacgagtggaagcccgatccgcaaacgaaacaggtgatcgacggctggaataaaaagcttgatgaagtggtgcaacaaacggtggcgcaatcgccggttgaattaaaacgtgcctatggtgaatcggcttccctcgggaacctggcggctgacgctttactggcagcagcgggtaaaaatacccaactggcgttaacaaactctggtggtatccgcaatgagatccccgcaggggcgattacgatgggcggcgtcatcagtacgttcccgttccccaacgaactggtgacgatggaactcacgggtaaacaattacgcagtctgatggaacacggcgcaagtttaagcaatggcgttttacaggtatcgaaaggcctggaaatgaagtacgacagcagcaagccggttggtcagcgggtaatcacactgactctgaatggcaaacccattgaagatgcgacggtttatcacattgctactcagagtttccttgctgatggtggagatggttttaccgcctttaccgaagggaaagcgcgtaacataacgggcggttattacgtttatcacgcggtggttgattacttcaaagcgggcaacaccattacggatgaacagctcaacggtatgcgcgtgaaggatatcaaataaaagtgcgcactgaattgactcaactgtttgttacccgttgattgcgcagatcctgtattcggcctacgcgagggcgcaggccaaatcagatgccttaacatcaccatccggtggcaggacgttgtttttcgaattagcccaggtgtcgctgtgttgtcagaatatgagtcaaaacgtgcgaggtggattgcgctatagagaaatcttttatcgcctctaattaagatgagtttttttcatcttccctgatttttcctcaccatcattggttatttttcggttgacgcccttcggcttttccttcatctttacatctggacgtctaaacggatagatgtgcacaacacaacatataacgataagcgattgatgaggtaaggtatgagcttttttcacgccagccagcgggatgccctgaatcagagtctggcagaagtccaggggcagattaacgtttcgttcgaatttttcccgccgcgtaccagtgaaatggagcagaccctgtggaactccatcgatcgccttagcagcctgaaaccgaagtttgtatcggtgacctatggcgcaaactccggcgagcgcgaccgtacgcacagcattattaaaggcattaaagatcgcaccggcctggaagcggcaccgcatcttacctgcattgatgcgacgcctgccgagctgcggatcattgcacgcgactactggaataacggtattcgccatatcgtggcgctgcgtggcgacctgccgccgggaagtggtaagccagaaatgtatgcttctgacctggtgacgctgttaaaagaagtggcagatttcgatatctccgtggcggcgtatccggaagtacatccagaagcgaaaagtgcccaggccgatttactcaacctgagacgaaaagtggatgccggagccaaccgcgccattactcagttcttcttcgatgtcgaaagctacctgcgttttcgcgatcgctgcgtctcggcaggcattgatgtggaaatcattccgggaattttgccggtttcgaactttaaacaggcgaagaaatttgccgacatgaccaacgtgcgtattccggcgtggatggcacaaatgttcgacggcctggatgacgatgctgaaacccgcaagctggtgggcgcgaatattgccatggatatggtgaagattttaagccgtgaaggagtgaaagatttccacttctatacgcttaaccgcgctgaaatgagttacgcgatttgccatacactgggtgttcgacctggtttataaatagtgtgccttttgtgaaaatcacacagtgatcacaaattttaaacagagcacaaaatgctgcctcgaaatgagggcgggaaaataaggttatcagccttgttttctccctcattacttgaaggatacaaatctaaaacccttttttataaagcatttatcctaaatcggacataatcaaaaagtcttaattacgatcaatttgatctacatctctttaaccaacaatatgtaagatctcaactatcgcatccgtggattaattcaattataacttctctctaacgctgtgtatcgtaacggtaacactgtagaggggagcacattgatgagcacgtcagacgatatccataacacgacagccaccggcaaatgcccgttccatcaaggcggtcacgaccagagcgcaggtgggggcacaaccacgcgcgactggtggccaaatcaactccgtgttgacctgttaaaccaacattctaatcgttctaacccgctgggtgaggactttgactaccgcaaagaattcagcaaattagattactacggcctgaaaaaagatctgaaagccctgctgacagaatctcaaccgtggtggccagccgactggggcagctacgccggtctgtttattcgtatggcctggcacggcgcgggtacttaccgttcaatcgacggtcgcggcggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctggaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggcctgatttacgttaacccggaaggcccggatcacagcggcgaaccactttcggcggcagcagctatccgcgcgaccttcggcaacatgggcatgaatgacgaagaaaccgtggcgctgattgcgggtggtcatacgctgggtaaaacccacggtgctggtccgacatcaaacgtaggtcctgatccagaagctgcaccgattgaagaacaaggtttaggctgggcgagcacttacggcagcggcgttggcgcagatgccattacctctggtctggaagtggtctggacccagacgccgacccagtggagcaactatttcttcgagaacttgttcaagtatgagtgggtacagacccgcagcccggctggtgcaatccagtttgaagcggtagacgcaccggaaattatcccggatccgtttgatccgtcgaagaaacgtaaaccgacgatgctggtgaccgacctgacgctgcgttttgatcctgagttcgagaagatctctcgtcgtttcctcaacgatccgcaggcgttcaacgaagcctttgctcgtgcctggttcaaactgacgcacagggatatggggccgaaatctcgttacatcggaccggaagtaccgaaagaagatctgatctggcaagatccgctgccgcagccgatctacaacccgaccgagcaggacattatcgatctgaaattcgcgattgcggattctggtctgtctgttagtgagctggtatcggtggcctgggcgtctgcttctaccttccgtggtggcgacaaacgtggtggtgccaacggtgcgcgtctggcattaatgccgcagcgtgactgggatgtgaacgccgcagccgttcgtgctctgccagttctggagaaaattcagaaagagtctggcaaagcttcgctggcggatatcatcgtgctggcaggtgtggttggcgttgagaaagccgcaagcgccgcaggtttgagcattcatgtaccgtttgcgccgggtcgcgttgatgcgcgtcaggatcagactgacattgagatgttcgaactgctggaaccaattgctgacggtttccgtaactatcgcgctcgtctggacgtttccaccaccgagtcactgttgattgataaagcacagcaactgacgctgaccgcgccggaaatgactgcgctggtgggcgggatgcgcgtactgggtgccaacttcgatggcagcaaaaacggcgtcttcactgaccgcgttggtgtattgagcaatgacttcttcgtgaacttgctggatatgcgttacgagtggaaagcgaccgacgaatcgaaagaactgttcgaaggccgtgaccgcgaaactggcgaagtgaaatacacagccagccgtgcggatctggtctttggttctaactctgtcctgcgtgcggtggcggaagtctacgccagcagcgatgcccacgagaagtttgttaaagacttcgtggcagcgtgggtgaaagtgatgaacctcgaccgtttcgacctgctgtaatctgaccttcttcagcgactgcctttcatgcagtcgctgaagtttctttaccggcgtatagtgtccacaggaaaactacacactggatctctcatgtctgccgcaggaaagagcaacccactggcaatcagtggcctggttgtgctcacacttatctggagttatagctggattttcatgaagcaagtcaccagctacatcggtgccttcgacttcaccgccttacgctgcattttcggcgctctcgttttattcatcgtccttttattacgtggtcgcggaatgcgcccgacgccgtttaaatacaccttagccattgccctgttacaaacctgcgggatggttggcctggcacagtgggcgctggtcagcggcggagcggggaaggtggcaatcctgagctataccatgccgttctgggtggtaattttcgccgcgttgtttctcggtgaacgcctgcgacgtgggcaatatttcgcgatactgattgccgctttcggcttatttttggtgttgcagccgtggcaactcgatttctcttcgatgaaaagtgccatgctggcaatcctctccggtgtgagttggggggcgagcgcgattgttgctaaacgtctgtatgcccgccatccgcgcgtggatttattgtcgctaacatcctggcagatgctgtatgcggcgctggtgatgagcgtggtcgctttactggtgccgcaacgtgaaattgactggcaacccaccgtgttctgggcgctggcctacagtgcgattctggcgacagcgctggcctggagcttatggttgtttgtattgaaaaacttgcctgccagtattgccagcttaagcacactggccgttcccgtttgcggcgtactcttttcctggtggctgctcggtgagaatccgggggcagttgaaggtagcggtattgtgctgattgtactggcactggcgctggtgagccgtaagaaaaaagaagccgtcagtgtaaaaaggatctgaattttttcttcatgtggggagatctcttatttagcaaaataccgatagtgccccaccatctgccagctaaacagtacatcttcttcctgcgcgcctgcgccaatgttatgtatcaccagcggcgtaccgtcgcgggcgaagccatctgacaccaccccaatatgtgccagcccgttatctaatcgccaggagacaatatcgcccgcttgatagtcactggggttcttgctggtggggcgtgttttatcgtggcgggtaaaccaggtttccagattaggcacccgacggtgatcgatgttgctgtccgggcgctttaactgccatttttgcgggtacgcagcaaaattcttcgccatatcttcgtgcaccagtttctgcaaatcgaccttctggctgcgcaatgcacggatcaccacatcggaacatacgccgcgttcttgcgggacatcaccgccaggataggtaagctgcacatacgccggatcgtaaaatagcgtgctgccgatttgcagtctggcgccgtctgcgatggcaagattggtgttagcctggatttgtaccacggttggtggaacggcgggagattttaaggagtaactggtaaataacgtcagaagactgaataacgccagtgaagctttcatctgtttcgtccgtgaaaataagagtcacagattcgaccttccgggctaacgattgttctgtggagaaaatgtccagaagcggataaaaaaacacccgaacaaggtggaagtttcagattactggcacagcgtgccggatgcggcgtgaacgccttatccggcctacaaaagtacgtaaatttactatattgcagagattgcgtaggcctgataagcgtagcgcatcaggcaattttgcgttcaaactcccggacaagccgggagtttggagtaggttattcccactcttgcaggaaacgctgaccatactggtcggctaccagcagtgcggcgtaaacctgatctggcgtcgcgccgccaggcatgttgtggatggtttcaccttctgcacatgccgcttctgccacaattcgcattttcgccgggacatcttctctaatatccagttgagcgagagttattggcaaacctaccgcatggctaagcgcagctacggtttcgatttcctccaccgacgcgttttccagcaccagctgcgtcagcgtaccgaatgctactttttcaccatgataatagtgatgcgcgtccgggatagcggtcaggccgttatgtaccgcgtgtgccgccgccagcccgccgctttcaaaaccaacgccactcaaataggtgttcgcttcaatcacgcgctccagcgccggagtcactacatgctgttcggcggcaagcatcgctttttcgccttcttccagcagggtgttgtagcacagttcagccagtgccagcgctgcctgagtgcacttgccacccgccatggtggtcgcgccgctacgggaacaggcacgcgcttcaaaccaggttgccagcgcatcgccaatacccgccgctaacagacgcgcgggcgcgccagcgacgattttggtgtcgacaatgaccatattcgggttatttggcaacagcagatagcggtcaaactcaccctcatcggtgtagataacagacaatgcgctgcacggtgcgtcggtagaagcgatagtcggtgcgatcgctaccggaacacccatgaaatgtgccagtgctttggcagtatcgagggtttttccgccaccgataccgagaattgcgccacactgcgcagtctccgcgatgccacgcagacggtcgatctcattttgcgaacattcaccgccaaacggcgcaatttctactaccagtccagcatctttaaagcttttctcgacagtggattgagcaaaacctaaaacaaatttgtcacccaccactaaccagcgttccgccagtggcttcaggtactcgcccagacgattaattacatctgcgccctggatgtatttacctggtgattgaataatgcggtccataattactcctttagagatgagtagtgtcaaatgcggcattccagtcgtgctcgaacttctctatagctgactctaccgcaggggtgttaagcatttgttgcgctacatctaagggcagtgtgatggattcacatccagccagcaaacaatccagcgcctgacgtggtgttttaaagctggcagccagcaccatgctttctggcgcatgcatttccagtaacgcttgcaactcctgtacagtacgaatgccgtcaccgccctgggcatctacgcggttaacgtatggagcaacgtatttggctccagccagcgccgccagtaatccttgcgcggcgctgtacactgcggttcccagcgtagtaatgccttctttcttcagcattttaattgctgccagaccttcagaggttaccggaattttcaccacaatgcccggaatagcgtcgcgcaggtgtttcgcttctttcaccataccctgcgcgtcgcggctcatggtctgagcaaacagaatgccctcatcaccgatcgctttttgaaggcgcggcagcacttcccagatggactccttgctggcagcgataatgctcgggttagttgtcaccccggcaatcgggaatatgcgtgccagacgttcgacttctgcgacgttagcggtgtccagatacagttccatgatgtttccttttacagttccagttcatgttgcagcaggctggcgatagcgtcggcagaggcggcgttaaccagcgcattacggaattcttcgtgcatgatgcgacgagcgaggcgcgagaaaatgcgcatatgttgatcgcccgcggcgtgtttgttcagggttaacataatgatgaattgcgcttcatcatcgccccagcgcactggcgcttgcagacgcgctacgctgatggtggattgctcaatgtgttccgatttactgtggggaatggcgaaactaaagcccagaccggtagagaaaacggcctcgcgcgcccacaagtcggcttccagtttacgcggatagcggcagcggcccgccagcagcaggttatcggtcatgcctttgagcacttcttctttgctgcgccagtcgctttccagtgtgatgcactcggcggtgaccagcggtgcgtcctgttgggtcatgcggaattgcgccagcaggtgttccacttccagcgaagtacggcaggccattgcctggttgagcaactggcggcactcacggctatcaagttgcgccatccgcgctttcgccgccggaattgatggtgcgctcatgctgagttcatccagccctaaaccgaccagcaacggcagcacggaacctttcgctcccagttcaccgcacagaccaatccatttgccctggcgatgcaccgcctgcacggcgtaatcgagcgcccgcaagaaggccggattcaggctgttgtagtgacgagtcaccttagcgttatcgcgatccactgccagtagatattgcgtcaggtcattactaccaatactaaagaaatcaatctcttcgcagcattgatcgatgatgaacatcaccgacggcacttccagcatgatgccgagctggatcttctcatcaaacggaatgtgttcgttacgcagttgctgtttggcttccgccagtttttctttcacccataagatctcttccattgaggagatcatcgggatcatgattttcaggctgccgtgagcagaggcgcgcaggatcgaccgtagttgtgtggtaaacaacgacgcgtattcttcataaatacgcaccgcgcgataaccgaggaacgggttagcttctgccggaatgttcagataatcaacgggtttatcaccgccaatgtccatagtgcgcacaataatgctgcgtccgttggcagactccagcgcctgacaaaaaatgttgtacagctcgctttcgcccggtgcactggtgcgatccatatagagcatttcagtgcggaacaaaccaacgccttccgcaccattgccgaatgcggcctgcgcttccacggagtgagcgatgttagcggcaatttcaatgcggataccgtcagcggtacgcgcttgctgggtcagccagacacgctgttgctcacgcagagcgtcctgtacgcgggcttcttgctgataataacgggccacggattcccctggctcaaccacaatcgcccctgcgttgccgtcgatataaatcgtctgatgctgccacggagtaagggcagcaatatccacacctaccagcgtcggaatgttgaacgaacgggcaaggatcacagtatgtgaggtggtgccgccacttttcagtaacagacctttgagatgatttttatccagttcgaggaactggctgggggtcagttcatcagccatacaaatggcgggctgcgtcagtttgcccggtgccgggaagcgttgctcaccgtagatttgctggagtaactggaagcagacgtcgcgtacgtccagggcacgttcttgcaggtagctgctgctggaacgggcgaactcttcgcaaaagtgattcgcactggcaacaatcgcttcggcgcagcttaatccggcgctgacacctgccagtaaatgttcgcgcagggaagtatcgccagccagggatcggtgcgcttccagaatcgcgctggtagcaccgtcgctatccagcagacgaaactctatgtttttcagtaccagcgtcagaccgttttccagtgcggattgttcggcgtcaacgcctttggctgcgggaagattacccagcgcattgagatctaaagaagagatcggcgtcagaatgccgcctgcgctaccactgcacacggtgcgagcacggataatttgcggattcagattggtcagtgaaaccggcagtggttccagttcgtcagattttacttccgccagcggtgcgtcgcagtgggggaattcatcgcgcagccattggcttaaacgctggtacgcttcctgttcgtcggccccggaaatcagtaactggcagttatcgcccaccagcgtatcggtgccaatcagcgcaagggcgcttttggcgttgcccttgcggtcagtgcgcaggttatgccactcaatttgtgatgaaaaagtattacacagcgtttcaacgtggcttgccggacgcgcatggacgccgttaggtagctcacaaataaattccacaatcagggccattgcctttctcccggtacggttttctgtttacaggataagagcgcacggtaacggcctgccatgtgacaaatctgccaaaagctggacaaatgtaatgtaaccgtcaatttgcgacgcgtctcacaagacgccgttttgcggcatgcttccggattatcgcaagttatgaggcggatcgcatttttgtactgatattacaaaagtccagtaaatggcctttttatccactgtttgctccgcctgcgattgcctattgtttcttccatcaaaaatatggacatgggctttcgcaagcccgggagcagcttatgaatgagttggtgcagatcctgaaaaatacccgtcagcatttaatgacgggcgtttcacacatgattcccttcgtggtatcgggcggtattttgctggcggtttccgtcatgttgtatggcaaaggcgcagtgccggatgccgtagccgatccgaatctgaaaaaactgtttgatatcggcgttgcaggtttgacgctgatggtgcctttcctcgccgcttacatcggttattccattgcagaacgttctgcgctggctccatgcgctatcggtgcctgggttggtaacagctttggcgcgggcttctttggtgcgctgatcgccgggattatcggcggcatcgtggtgcattacctgaagaaaattccggtgcataaagttctgcgctcggtgatgccaatcttcatcattccaatcgtcggcacactgattaccgctggcgtcatgatgtgggggctgggcgagccggtgggggcgttgaccaacagcctgacccagtggcttcaggggatgcagcagggcagcattgttatgctggcggtgatcatgggtctgatgctggcgttcgatatgggcggcccggttaacaaagtggcctatgccttcatgctgatttgcgttgctcagggtgtttataccgtggtggctattgccgctgttgggatttgtgttccaccgctggggatggggctggcgacgctgattggtcgtaaaaatttctccgcagaagagcgcgaaaccggcaaggcggcactggtgatgggctgtgttggcgttactgaaggggcgattcctttcgccgctgccgatccgctgcgtgtcattccttccatcatggtcggttcagtttgtggtgcggtaactgcggcgctggtcggtgcgcagtgctatgcaggctggggtggtctgattgtgctgccggtggttgaaggtaagttgggttacatcgcggcagtggctgtcggggcggttgtgacggcagtctgcgtgaacgtgctgaaaagtctggcgcgtaaaaatgggtcttcaactgaagagaaggaagacgacctggatctggattttgaaattaattaattgaggaacgagccatgacgaaaattatcgcagtaaccgcatgtccttcaggtgttgcccatacttatatggcggcagaggcgctggaaagcgccgcgaaagcgaaaggctgggaagtgaaagtagaaacccaggggtcgattggtctggaaaatgaactgactgcggaagacgtggcaagcgccgatatggtgattttgaccaaagatatcggcatcaaatttgaagagcgttttgctggcaagactatcgtgcgtgtcaacatcagcgacgcggtaaagcgtgctgacgccattatgagcaaaattgaagcccacctggcacaaaccgcttaagttcttatcccgcccgcaagggcgggttcgctttcccacaggagttcctcatgacgaatcgtatctctcgcctcaaaactgcactgtttgccaatacccgtgaaatctcgctggagcgggcgttgctttataccgccagccatcggcaaaccgaaggggagccggtgataatgcgtcgggcgaaagcaacagcgtatatccttgaacacgttgaaatttcgattcgtgatgaagaactgattgccggtaaccgcaccgtaaaaccacgcgccgggattatgtcgccggaaatggacccttactggctgctgaaagagctggatcaattcccgacgcgtccgcaggaccgctttgctatcagcgaagaagataaacgtatctaccgcgaagagttgttcccgtactgggaaaaacgttcgatgaaagatttcatcaacgggcagatgacggatgaagtaaaagccgcgaccagcacgcagattttcagcatcaaccagacggataaaggccaggggcacattattattgattacccgcgcctgctgaatcacgggctgggggagctggtggcacagatgcagcaacattgtcagcaacagccggagaatcacttttatcaggcagcgctgttactgctggaagcctcgcagaaacatattttgcgttacgccgaactggcggaaacgatggcggcaagctgcactgatggccagcgtcgcgaagaactgctgaccattgcggagatctcccgccataacgccgaacataagccgcagacgttctggcaggcgtgccagttattctggtacatgaacatcattctgcaatacgaatccaacgccagttcgctatcgttggggcgcttcgaccagtatatgttgccgttctatcagacatcattaacccagggcgaagatccggcattcctgaaagaactgctcgaatctttatgggtgaaatgcaacgacatcgtgctgttgcgctccaccagtagcgcgcgttatttcgcaggtttccctaccggctataccgcactgctcggcgggttaaccgagaacggacgtagcgcggtgaacgtgctttcgttcctttgccttgacgcttatcaaagcgtgcaattaccgcaaccgaacctcggcgtgcgcactaacgccttgatcgacacgccgttcctgatgaaaaccgcagaaaccattcgcctcggcaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaacctgctgaaagtgatggaaatctgcctgcatgaaaatgaaggcaacgctgcgctgacttatgaaggtttactggaacagatccgcgccaagatcagccactacatcaccctgatggttgagggcagcaatatttgtgatatcggccatcgcgactgggcacctgtaccgctactctcgtcttttatcagcgattgtctggaaaaaggccgcgatattactgacggcggcgcgcgttataacttctccggcgtacaggggatcggtatcgccaacctgagcgattctctccatgcgttgaaagggatgatttttgatcaacagcgtttaagttttgacgaattgctgtcggtattaaaagccaacttcgccacgccagaaggcgaaaaagtccgcgctcgcttaattaaccgcttcgagaaatacggtaacgatatcgacgaggtggataacatcagcgccgaactgttacgccactactgcaaagaagtggaaaaataccagaacccgcgcggcggctacttcacgccaggatcgtataccgtttctgctcacgtcccgttgggatcggtggttggcgcgacgccagacggtcgttttgccggggaacaactggcagacggtggcttgtcacccatgctgggtcaggatgcacaagggccaacggcggtgctgaaatcagtcagtaagctcgataatacgctgctgtctaacggtacgttgctgaacgtgaaattcactccggcgaccctggaaggtgaagcgggattacgcaaactggccgacttcttacgggcgtttacccagcttaagttgcagcatattcagtttaacgtggtgaacgccgacacgttacgggaagcgcaacagcgcccacaagattatgccgggctggtggtgcgcgttgccggatacagcgccttctttgtcgaactgtcgaaggagatccaggatgacatcatccgccggacagcgcatcagctgtaacgttgtggaaacgcgccgcaatgatgtggcgcgcattttcaacattcagcgttattcactgaatgacggcgagggcattcgtacggtggtcttttttaaaggctgtccgcatctttgcccatggtgtgctaatccggagtcgatctccggcaaaatccagacggtgcgcagagaggcgaaatgtctgcactgcgcgaaatgtttgcgtgatgcggatgaatgcccctccggggcatttgaacggattggtcgcgatatcagccttgacgctctggaacgggaagtgatgaaagatgacattttctttcgcacgtccggcggtggcgtcacgctttctggcggcgaagtgttaatgcaggcggagtttgcgacccgttttttacagcgactgcggctatggggtgtgtcatgcgccatcgaaactgccggagacgcgccagccagcaagctgttaccgctggcgaaattgtgcgatgaagtgttgttcgatttaaaaattatggatgcggctcaggcgcgggatgtggtgaagatgaacctgcaacgcgtgctggagaatctgcgtttgctggtgagtgagggtgtcaacgtgatcccgcgtttaccgctgatccctggtttcacgctcagccgggagaatatgcagcaggcgctggacgtgctgatcccgctgaatatcaagcagatccatctgttaccgtttcatcagtacggcgagccgaaataccgcctgctggggaaaacatggtcgatgaaagaggtttctgcgccgtcgtcagccgatgtggcaacgatgcgtgaaatggcagaacgggccggatttcaggttaccgtgggaggttaaaatggcatatctggtggcagtaaccgcctgcgtaagcggcgtggcgcatacttatatggcggcggaacggctggaaaagttgtgccagttagagaagtggggcgttagcattgaaactcagggcgcgttgggaacggagaatcgtttagcggacgaggatatccgccgggcggatgttgcgctgttaattacggatatcgagcttgccggtgctgagcgatttgaacattgtcgctacgtgcaatgcagcatctacgctttcctgcgtgagccgcagagggtgatgagcgcagtgcgcaaagtgctttctgcgccgcagcaaacccatcttattctggagtagtcggtttttctgtcagttggctgtggtactgccgacgatattccgacggcgagcgttcggtatttttacgaaacagacggcagaagtagttgctgtcgacaaagccgcaggcgtgcgccacttcttttaccttcaggtcatagcctttcaataatgtcttagcgtgctccagtcgcgtgtgattcaggtattcgttaaaaccaatggcccccgttttttgaaacaggtgcgagaggtaatttggcgaaatatagaacgcctgtgcgacagattcgcgggtaagtgcggaggcatagcgttcgtcgatataatcacgaatagcttcgaatagagcctggctgcgtgaggcggtctgtatttggctgccgagcaaatcgcggcagtggctaagcaggctggcgacgataagtctggccgtttgctgctcctgcgactgcatttgcatttcattgagcgtttgtagcagaaaagaaccaatgcgcgggccgcgtcgggcgacgtgttgcttcgccagattttgatattgtttgccatcccattgcacaacgctgaagccgagttgctgtttgccaaacagcacgctaaaggtggtggcgggggcttgccattgtggaaaattccagccaccagcagggacgtacagcacatcgccgggaactaacgctgctccagcgccggtatcaataaactcaccttccagcacaatttccagccgtggaaaatcgacctgatacgcaagatcgggcaccgggccgttgctgctggcaaagtaaatctggcgcagggacagcgggccgtttatcaggcgggagagcagatagctgacgtcgtgatacatgttattcccttaggtatgtagacgggaaaacagtaactggcattatgaaaaaaggccacctgaaaagtgtggcctgatgggagttcgatgtaaacattgcgacagtttcagtcgccttgtattgccggatgcggcgtaaatgccttacccggcctaccgccgcgatctgtaggccggataagacgcgtcaagcgtcgcatccggcaaataacatctggctgataattactgattacccacctgatcgccatacggcagagtgtcgtaatcgatcagtgcgtttttcttatacgggttaccaatccagcgggtagtttctttgaactgcggattcaccactgaacgggttggatcgtaaccgtcgtaagataagcccgccaaatctgaccaggtgtggatcagttccgccaggctgtatttacgatcaacatcctgtgagaaatcacgcggatgagtcgcttgccatttttctgacgtccacagcaggaacggaatggtgtacatatgacgcgtcgggttgtcttcattacgcccctgagttttgtgcggcggcgtgtcgtaaacctcttcaccgtggtcagagaaataaaccaggaaaccgttcggatcggtcgctttaaagtctttaatcaggctggcaaccacgtgatcgttgtacaggttagcattgtcataatcattatatgactccagctcttctgcgtttaatcccggtggaacatgctctgtattaccgtcaaatttgccctgatcttccggataacggtacttgtacttgatatgcgtacccagcagatgaacgatgatcagtttcttcggcgcagggtccttcagcacttcctggaacggcttcagcacgttggtgtcgtattcacgcgcactctgcgtacgttgctggttcatgtagtactgcttgtcggtctggcgcgaaaataccgtcagcatggtattgcgggcggtcatcgtctgctggttggtgatccagaaggttttataacccgcctgtttcatcatgttcatcagcgacggctgcgtcagatacagatccgggttcttttcattagcaaaggtcagcgcctgttgcaggatttcaatggtgtacggacgagacgtaaccacgttattaaacacggtcagattcggatcggttttatgcagcgcatccagctccggcgtggtttcacgcggataaccgtacagactcatgcgtccacgctgggtcgattcgccaattaccagcactaaggtgcgcggttcgttacccgattcatctttgaaattagccagcggcggcaaggcattattttcattcagtagctttgttagcgagtttagttgctgacgatactgataatagccggtcaggaattgccacggtgcggcaggctccatacgcgatgccaggttatccaacgttttctcaaacggcttgttcttgataaacgtattcatggcgatcggatgcagaatcaagccataaagcagggcaaaagagacaacataacgccacggctttggaatatagaccgggcgcaggcgtgtccacagcagaactgccaccgccgtataggccagcgcgataagcacaattttcaggctgaaatactggcttaaatactcgctggcttcgttggtgttggtttcgaacatcacaaacagaacgctctgcgagaactcctgaccgtagatgacgtaatagcacagcgccgccagagaggccgcccatagcaccacgccgatcactgcggcaataattttaatccgcttcggaaagaggaataccgggatcaaccacagcgaactgaataacagcgagtcgcgaatgccgttagtgccactataaccactgatgtaaataatggcctgtagcagagtagagaaaaaccaaaagtagagcagtgcccaacccagggctttccagctaaaaaggggtttagcctggacttctgtggaatgcatagtaagaacctgtcttgaaaaaaatatcgccgaatgtaacgacaattccttaaggatatctgaagggatatccagattttgaataaaatgcagacagaaatatattgaaaacgagggtgttagaacagaagtatttcagaaaaccctcgcgcaaaagcacgagggtttgcaggagaggaagattagccggtattacgcatacctgccgcaatcccggcaatagtgaccattaacgcctgctcgacgcgaggatccggttcctggccttctttttctgcctggcgggagcggtgcagcaactcggcctgcaatacgttcagcgggtcggtgtaaatattccgtagctgaatagactctgcaatccacggcagatcggccatcaggtgagaatcgttggcaatcgccagcaccactttgatgtcttcttcttgcagattgcgtaactctttacctaacggccacagtgctttgtctaccaggcgttggtcatagtattccgccagccacaggtctgctttggcgaagaccatctccagcatgccgagacgcgtcgagaagaatggccaatcgcggcacatggcttccagctcgttctgtttgccatcttcgaccactttttgcagcgccgtacctgcacccagccaggcggggagcatcaggcggttttgcgtccaggcgaaaatccacggaatagcgcgcagtgactcgacgccgccggttgggcgacgtttcgccggacgtgaacccaacggcagtttacccaattcttgttccggcgtagcggagcggaagtaaggcacaaaatctttgttttcacgtacgtagccgcggtagacatcgcaggagataacagacagttcatccataatacgacgccagctctctttcggctcaggcggtggcagcaggttggcttccagaatcgccccggtgtacagcgacaggctgctgacggtgatttctggcagaccatatttaaagcggatcatctcgccctgttcggtcacgcgcaggccacctttcaggcttcctggcggttgtgacagcagcgccgcatgggcaggtgcgccgccgcgaccaatggaaccgccgcgaccgtggaacaacgtcagctcaatacccgctttttcgcaggttttgattaatgcatcctgtgcctgatattgcgcccaggaagctgccatcacgcccgcatcttttgctgagtcggaatagccaatcatcaccatctgtttgccctgaatcaggccgcgataccagtcgatattcagcagctgggtcatgacatcgttggcgttgttcaggtcatcgagggtttcaaacagcggagcaaccggcatcgcaaacccgatacccgcttctttcagcagcaggtggacagccagcacgtcggacggcgttttcgccatcgagatcacgtaggcggcaatggagccttgcggcgcttcggcaatcacctggcaggtatcgagcacttcgcgcgtttcggcgcttggttgccagttgcgcggtagaagcggacgtttggagttcagttcgcggatcaggaacgcctgtttgtcggcttctgaccagctctcgtagtcgccgataccgaggtagcgggtcagctcgcccagcgcttcggtatggcgggtgctctcctgacggatatcaatacgcaccagcggtacgccgaaacatttcacgcggcgcagggtgtcgagcagatcgccgttggcgataatacccatgccacacgcctgaagtgactggtagcaagcgtagagcggttcccacagttcttcgttttgtgtcagcaggccttctggttttggcagttcttcgcctttcaggcgcgcttccagccatgcctgtgtcgccatcaggcgagaacgcaggtttttcatcagatagcgatacggttctgcggcaccttcttcgccaaccagcgccagcagttcaggggtcgcttcaaccatcgacagttcagaaaccagcacctgaatatctttcaggaacagatcggtggctttccagcgactgagcagcaggacgtggcgggtgatatcggcagtgacgttcgggttgccgtcgcggtcaccgcccatccacgaggtaaaacggaccggaacaaattcgacgggcagtttgtagccgagattctcttccagttgttcgttcagttcgcgcaggtaattcggtacgccttgccacaggctgttttctactacggcaaagccccatttggcttcatctaccgggcttggacgcagcttacggatttcatctgtatgccatgactgggcgatcaactggcgcaggcggcgcatcagctggttatgttcgtagtcggcgatatctttgttatcgagctgttttaagcaggcgttcacttccaccattttgtggatcagtgtacgacgggtaatttcggttgggtgagccgtgaggaccagttccagcgacagcgattccactgctttttttatggtgtcttcgctcagttccggctggtttttcagtttgcgcagggtgcgggcgatcacttccgggttgctggcagcttcgcctttcggcgaaatgctgtggtattgctcggcggtgttggccaggttcagaaactgactaaacgcacgcgcaacgggcagcagctcgtcgttcgacaaattttgtaaggtggtgagcaactcctggcggttagcatcattgccagcgcgtgaagatttggacaacttacggatagtttctacgcgttcaagaatgtgttctcccaacgcatccttgatggtttctcccagcactttgccgagcatactgacattactacgcaatgcggaatattgttcgttcatattaccccagacaccccatcttatcgtttgatagccctgtatccttcacgtcgcattggcgcgaatatgctcgggctttgcttttcgtcgtcttttataaagccacgtaaaagcggtgacgtcaaatgctgcgaaatcgcttcagcaaacgaataaatagcaggaatttacgccattaaattcacgacgctttaaataagcgtaacttatgggaatgttaaaaaatcgcctcgaataacaccaaaggtgtaggtcggataagatgcgcaagcatcgcatccgacattgtttggcctacgttttaatgccagcaaaaatggtgaatcacctgggtgatcagttcgcgggtgggcttgataaacctcgtctccagatattcatcaggctgatgagcctgattaattgagccaggccccagaaccagcgtcgggcataacgtttgaataaacggcgcttcggtacagtaattcaccacttcggtctttgctccgagcaatttctcaaccacttcaaccagttgatgattcggtgggcattcatagccagggatcggcggatgcagctcgtcgaccgtcagacgacccggccagcgttcgctcactggagccaatgcatcgttgagcaaaccgttaagttcattgagtgtcatgcctggcagcggacgaatatccatatgcaactcacaacaagcgcaaatacggttagatgcatcgccgccgtggatatgcccgaggttgagcgtagggtatggcacggtaaacgcgtcgtagtgataacgttctttcaggttatcgcgcaattgcaaaatatgcccgatggcgtcgtgcatcagttcgatagcgttaactccgcgtgctggatcgctggagtggcccgactggccctgaatacggatggcgttagagatatgacctttatgcgcgcgtaccggttgcagcgacgttggctcgccaatgatggcgcaatccgggcgcagggcggtagtttcggcaaaataacgcgctccggccatactggtttcttcatcggcagtcgccagaatgtagagcggttttgcaagcttcgtgacgtcgacatcgcgtagcgcatcaaggataaacgcaaaaaagcctttcatgtcggcggtgcctaagccgtaaagcttgccgtcatgctccgtcaacgtaaatggatcgcgcgtccagcgtccgtcatcaaatggcaccgtatcggtatgccccgccagcaacaaaccgccagccccctgtccgcaactggccagcatattaaatttgttgcgagttcctggcacaggctgtacttccacattgaagcctaaatccttaaaccagtccgccagcagagtgattaaatctgcattgctttgatcgagtgcctcttccgtggcgcttattgaaggtgtggcaatcagagcacggtaaatctcgataaatggcggtaatttgtttttcattgttgacacacctctggtcatgatagtatcaatattcatgcagtatttatgaataaaaatacactaacattgagcgtaataaaacccaccagccgtaaggtgaatgttttacgtttaacctggcaaccagacataagaaggtgaatagccccgatgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtggtgtttctcgccaccgcccatgaagtcagccacgatttagcgccgcaatttcttgaagcaggctgtgtggtgttcgacctttccggcgcgtttcgtgttaacgatgtcgccttctatgaaaaatattacggctttacccatcaatacccggaactgctggaacaggcagcctacggtctggcggagtggtgcggtaataaattaaaagaagcgaacttgattgccgtgccaggctgttatccgacggcagcacagctggcgctgaaaccgttgattgatgccgatcttcttgacctcaatcagtggccggtgatcaacgccaccagcggcgtgagcggtgcaggacgtaaggcagcgatttcaaatagtttttgtgaagttagcctgcaaccgtatggcgtctttacccatcgccatcaaccagagatcgccacacacctcggtgctgacgttatcttcaccccgcatctgggcaatttcccgcgcggcattctcgaaaccattacctgccgcctgaaaccgggtgtgagccaggtgcaagtggcgcaagcgttacagcaggcgtatgcccataaaccactgatgcggctgtatgacaaaggcgttccggcgctgaaaaatgtcgttggactgccattctgcgatatcggttttgccgttcagggcgagcatctgattattgtggcgaccgaagacaacttactgaaaggcgcggcggcacaagcggtgcagtgcgccaatattcgtttcggctatgcggaaacgcagtctcttatttaagggtgcaatgatgaatccattaattatcaaactgggtggcgtactgctggatagtgaagaggcgctggaacgtctgtttagcgcactggtgaattatcgcgagtcacatcagcgtccgctggtgattgtgcacggcggcggttgcgtggtggatgagctgatgaaagggctgaatctgccggtgaaaaagaaaaatggcctgcgggtgacgcctgcggatcagatagacattatcaccggagcactggcgggaacggcaaataaaaccctgctggcatgggcgaagaagcatcagattgcggccgtaggtttgtttctcggtgacggcgacagcgtcaaagtgacccagcttgatgaagagttaggccatgttggactggcgcagccaggttcgcctaagcttatcaacagcttgctggagaacggttatctgccggtggtcagctccattggcgtaacagacgaagggcaactgatgaacgtcaatgccgaccaggcggcgacggcgctggcggcaacgctgggcgcggatctgattttgctctctgacgtcagcggcattctcgacggcaaagggcaacgtattgccgaaatgaccgccgcgaaagcagaacaactgattgagcagggcattattactgacggcatgattgtgaaagtgaacgcggcgctggatgctgcgcgcacgttgggccgtccggtagatatcgcctcctggcgtcatgcggaacagcttccggcactgtttaacggtatgccgatgggtacgcggattttagcttaagttttgttggccggaggcgcagctttccggcattgaatttcaaaataaggaaacagagttatggcactttggggcgggcgttttacccaggcagcagatcaacggttcaaacaattcaacgactcactgcgctttgattaccgtctggcggagcaggatattgttggctctgtggcctggtccaaagccctggtaacggtcggcgtgttaaccgcagaagagcaggcgcaactggaagaggcgctgaacgtgctgctggaggatgttcgcgccaggccacaacaaatccttgaaagcgacgccgaagatatccatagctgggtggaaggcaaactgatcgacaaagtgggtcagttaggcaaaaaactgcataccgggcgtagccgtaatgatcaggtagcaactgacctgaaactgtggtgcaaagataccgttagcgagttgctgacggctaaccggcagttacaatccgctctggtcgagaccgcgcagaacaatcaggacgcggtgatgccgggttacactcacctgcaacgcgcccagccggtgacgttcgctcactggtgcctggcctacgttgagatgctggcgcgtgatgaaagccgtttgcaggacgcgcttaagcgtctggatgtcagcccgctaggctgtggcgcactggcaggaacggcctatgaaatcgatcgtgaacagttagcaggctggctgggctttgcttcagcgacccgtaacagtctcgacagcgtttctgaccgtgatcatgtgctggaactgctttctgctgccgctatcggcatggtgcatctgtcgcgttttgctgaagatctgattttctttaacaccggcgaagcggggtttgtggagctttcggaccgcgtgacttccggttcatcattaatgccgcagaagaaaaacccggatgcgctggagctgattcgcggtaaatgcggtcgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccgcgttgccaggaagcggcgcagcagggttacgccaacgctactgaactggcggattatctggtggcgaaaggcgtaccgttccgcgaggcgcaccatattgtgggtgaagctgtggtggaagccattcgtcagggcaaagcgttggaagatctgccgctcagtgagttgcagaaattcagccaggtgattggcgaagatgtctatccgattctgtcgctgcaatcgtgcctcgacaagcgtgcagcaaaaggcggtgtctcaccgcaacaggtggcgcaggcgattgcttttgcgcaggcgcggttggggtaatttgtttatattgctcccctgaaaatggggagcttaccacgcctacaaagtgtgacacttcgtaggcggataaggcgtttacgccgcatcaggcagaaatttgtcagcattctggtgaccttaaatttaacgcccaaccagaaccattatttgtcacattcctttttattcttgcgtcttctttaccttcactctccccataaaaattatattttcaatacatcagccaatacatactttaattaattgaatataattcatttctattgctgtgttcatttttaatgattaatggagtttgttatgtgattatttaacgtgttgttttaacgataatggctaattattcaggtggtttttgagggtgttttttctcctcggtagaaatttttatttttaatgtgatcacggttgaataatcaccttttctctcttgtatggtagtaggcgtaaaattaagtttgaagtgtctatttacaatacaggagattgcaataatgaaaattattgctgtggatgtttttgttacttgtcccgggcgtaatttcgttacgcttaaaataaccactgaaagcggactttgtggattaggagatgccacgttaaatggtcgcgaattgtcggtcgcttcttatctgaaagatcatctttgtcctcaattaattggccgcgatgccagccgtatcgaagatatctggcaattcttttataaaggagcttactggcgacgtggtcccgtcacgatgtcggccatttctgccattgatatggcgttgtgggatatcaaagctaaagcggcaaatatgccattgtatcaactgcttggtggcgcttctcgtgaaggcgtgatggtttattgccacaccaccgggcggacgattgatgaagtccttgaagactatgcaaagcaccagcagatgggctttaaggcgattcgtgtgcagtgtggtgtaccgggtatgcaaaccacctatggtctggcgaagggcaaaggactggcgtatgaaccagcaaccaaaggcctgtggccagaagagcagttgtggtcttcagaaaagtatctcgattttacgccgaagttatttgaagcggtgcgtaataagttcggttttaacgaacatctgttgcatgacatgcaccatcgcctgacccccatcgaagcggcgcgctttgggaggagcattgaggattaccgcctgttctggatggaagatccgacgcctgccgagaaccaggaatgttttcgtctgattcgccagcataccgtgacgccgattgcggtcggtgaagtgtttaacagtatctgggactgcaaacagttaatcgaagagcagctgattgactatattcgcacgacgattacccatgcaggcggcattaccgggatgcgacggattgtcgattttgcatcgctttatcaggtacgtaccggttcgcatggcccttcagatttatcgcctgtttgtcatgcggcggcgctgcattttgacctctgggtgccaaactttggcgttcaggagtacatgggctattccgaacaaatgtttgaagtcttcccgcacagctggcgcttcgatgaaggttatatgcacccaggcgatgaaccggggctgggtatttctttcgatgagaaactggcggcgaaatatccgtatgacccggcgtatctccccgtcgcacgactggaagatggcacattgtggaactggtaatagcggttcgcttaattattttctgaatattcatcaaatcgattaattccgctcaaggagctaaaaatggacgttgatgtgtcaaccagtgttgcgggtaataaaccgcaacggattcgtcgtattcagacagtgaccctggttttattatttatggcggggatcgttaattttctcgaccgttcgtcattgagcgtggcaggtgaagcaattcgtggcgagttaggattatccgctaccgagtttggtgttttgctttctgcattttctctgtcttatggtttttcacaacttccttccggtattttgctagaccgctttggcccacgaatagtgttaggcgcaggcttaatattctggtcattaatgcaggcattaacaggaatggttaattcttttagccactttattttaatgcgtatcggtctgggtattggcgaagcgccatttatgcctgcgggagtaaagtcgatcaccgactggtatgcgcaaaaagaacgcggcacggcgctggggatttttaactcatctaccgttatcggtcaggctatcgcgcctcctgctcttgtattgatgcaactggcatggggctggcggacgatgtttgtcatcatcggcgtagcagggattctggttgggatctgttggtacgcgtggtatcgcaaccgggcgcagtttgtcctgaccgaggaagaacggacatatctctccgcgccggttaaaccgcgtccacagttacaatttagcgagtggctggcgctgtttaagcatcggacaacctgggggatgattttaggtttctctggcgtcaattataccggttggctctacatcgcgtggttacccggttatttgcaggccgaacaaggtttcagtctggcgaaaaccggttgggtggcggcaattcctttcctcgcggcggcggtcgggatgtgggttaacggtattgttgtcgatcggctggcgaaaaaaggctatgacctggcgaagacgcgtaaaacggcgattgtctgcggtttgatgatgtcggcattaggcacgttgctggtcgtgcaatcttcctcgccagcccaggcggtagcgtttatctcaatggcgctgttctgcgtgcatttcgcgggaacatctgcatgggggctggtgcaggtgatggtgtcagaaacaaaagtggcttccatcgccgggattcaaaactttggcagttttgtttttgcttcctttgctccgatcgtaaccggttgggtcgtggataccacacactcgtttaatctggcgctggttatcgcggcctgtgtgacgttcaccggggcgctgtgttacttctttattgtcaaagatcggattgagtaaccgttactatcaggctctcttgctgtgggcctgtagaataaaaaaaagcggatcctggagatccgcaaaagttcacgttggctttagttattcgagttgagaaactctcgaaacgggcagtgacttcaagggttaaaagaggtgccgctccgtttctgtgagcaattatcagtcagaatgcttgatagggataatcgttcgttgctatgctacctatcgccgcgaactatcgtggcaatggaggatggataatgaatattcgtgatcttgagtacctggtggcattggccgaacaccgccattttcggcgtgcggcagattcctgccacgttagccagccgacgcttagcgggcaaattcgtaagctggaagatgagttgggcgtgatgttgctggagcggaccagccgtaaagtgttgttcacccaggcgggaatgctgctggtggatcaggcgcgtaccgtactgcgtgaggtgaaagtccttaaagagatggcaagccagcagggcgagacgatgtccgggccgctgcatattggtttgattcccacggttggaccgtacctgctaccgcatattatcccgatgctgcaccagacctttccaaagctggaaatgtatctgcatgaagcacagacccaccagttactggcgcaactggacagcggcaaactcgattgcgtgatcctcgcgctggtgaaagagagcgaagcattcattgaagtgccgttgtttgatgagccaatgttgctggctatctatgaagaccacccgtgggcgaaccgcgaatgcgtaccgatggccgatctggcaggggaaaaactgctgatgctggaagatggtcactgtttgcgcgatcaggcaatgggtttctgttttgaagccggggcggatgaagatacacacttccgcgcgaccagcctggaaactctgcgcaacatggtggcggcaggtagcgggatcactttactgcctgcgctggctgtgccgccggaacgcaaacgcgatggggttgtttatctgccgtgcattaagccggaaccacgccgcactattggcctggtttatcgtcctggctcaccgctgcgcagccgctatgagcagctggcagaggccatccgcgcaagaatggatggccatttcgataaagtgttaaaacaggcggtttaagccatttagcgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatacccagaatctcttttgtttcccgatggaacaaaattttcagcgtgcccacgttcatgccgacgatttgtgcacgtgccagatgtttaaactgggcgcggcccacttcatatggcactttcatcgcggtcagctgctgttcggttttgcctacagagctgatttccgggatggtgtaaatgccggtagggatatcttcaatcagatgtgcggtggcttcacctttcaccagcgcctgcgcggcaatgcgcccctggtcataggctgccgacgccaggctcggataaccaatcacgtcgcccaccgcgtaaacgtgcggctgtgcggtctgatacatgctgttgaccttcagctgtccgcgactgtcagtttccagcccaatgttctgtaacgccagcgaatcggtattaccggtgcgaccgttggcatagagcagacagtcagctttcagttttttacccgacttcagatgcatgatcacaccgtcgtcacagccttcgatcttctcgtactcttcgttgtgacgaatcactacgccactgttccagaagtgataggagagagaatctgacatctcttgatcgagaaatgccagcaggcgatcgcgggtgttgatcagatccacttttacatccataccgcggaagatcgacgcatattcacagccgatcactccagcaccgtaaataagtacatggcgcggttcgtggtgcatgctaagaattgagtcgctgtcataaatgcgtggatgggtgaaatcaacatctgttggatgatatggacgagagccgcaggcaataacaaatttttcagcagttagtgtttcgacgctgccgtccgggcaatccagcgccaacgtatgctcatcaacaaagcgagcgttcccctgcaatatttcacagtgattacgttcgtaaaatccctgacgcatgcgcgtttgttgattaatcacgttatcggcatggttaaggatatcggcaaaagaagagcggagcagtcgggaatggtcgctgtatagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccatcgcagcgccttcgccgccggggccggaacctattactatggcatcgtaatcgtaggaatgtggcatggtagggcttacctgttcttatacataaaagcaacagaatggtaacattttatcgcgggtaagccaattgatccccgtcatttatctggctatatcgtgagcggcctttgctttgtcttcctccttcttattttatttattcactattaatcgctttttcttatggctgatagttttatcttgccgaagcgtgcttttttgttattgtctttatgaaatcttcttataaaacaaatatataaatattttatattgatgagttatttgtatttataccatcaataaaatccgttaattagcctgtttataagtgaataaaggaatagccgatgatcgaacactatattcgtgggtttgaggaagaacttcgcgagatccgccatcagatccacgaaaacccggagctgggattacaagaatttaaaaccagtgctttggttgcggaaaagctgcgccagtggggctatgaggttgagcaagggctggcgacaaccggcgtggtagccacgttaaaagtgggcgacggagagaaaagtattggcctgcgggcggatatggatgcgttgccgatttatgaaaatagtggcaagccctgggccagtaaacatcctggtttaatgcacgcctgcgggcatgacgggcataccaccatactgctgggggctgcgcgttattttgccgaaacccgccgttttaacggcacgttacgccttatcttccagcctgcggaagagatgattaacggcggtgagatcatggttaaagaggggctttttgatcgtttcccctgcgatgtcattttcgggatgcacaacatgccgggtttgccggtcggcaagtttttcttccagcctggggcgctgatggcgtcaatggatcagttccatattacggttcgtggttgtggcggacacggtgcgatcccgcacaaagccatcgatccagtgctggttgccgcacatatcaccaccgcattacaaagcattgtgtcgcgcaatgtcgatccgctggaagcggcggtaattaccgtcggcagcattgttgcgggtgaggcggctaacgtcattcctgacagtgctgagatgaaaatcagtgtccgctctcttagccgcgatacccgacaacttcttctgacccgtattcctgctcttgcacaagcccaggctgccagctttggcgctacggctgaggttacgcatgttaacggtacaccggtattagtaaatgacgaggagatggcgcgcttcgcctggcaggtggcgtgcaaaacatttggtgaagatcgggctgagtttggcatcaaacccctgatgggcagtgaagatttctctttcatgctggaagcccaacccaaaggcggtttcctgttattcggtaatggcgatgtcggggaaggttcctgcatggtgcataaccccggttacgactttaacgatgcaagcctggtcccggcaagcagctactggggcgcactggttgaagcctggctgcaataaataaaacaacacacaacaacactttttggcaaggaacatggaatgacggcgatcgtaaatgaaaccgtgagtgtgaagaaaaagcccagcggcaggcgggtgatctttgcctcggcgtttggcaatgcgctcgaattttttgattttggcgtttacaacttttttgtggtctatatcagtacgcttttcttcccacccagtgccgatcataacgtcgcgctgttactggcatttgcaacgtttggtgtgagcttttttatgcgtccgctcggtgggattatcgttggtgcctgggccgatcgcttcgggcgtaaaccggcgatggtgttcactattgctctgatgagcctcggtacgctgatgatcggcatcgcaccgacgtatgaaacggcgggctattggggaactgcaacgctggtgctggcgcgtctaattcagggcgttgcggcaggtggtgaagtcggggcttcaatgtcgctactggtggagtcagctccggcaaatcgtcgcggcttttacagcagttggtcactggcgacccaagggctggcaacgaccttcggtggggttgttgctttaggtctgagcgcatggctaccgttcgccacaggttcagaaaccgtaatggcagaatggggctggcgtgtgccgttttttattggcgtgttattagcacctatcggttgctggttgcgtctgagcctggaaaatgacgtacctgagccagtgcgcaataaaaaagctgctaccagcgaaagcgcgttttctctgctcctgcaacataaggcgactatcgttaatggcgttttactcgctattggtagcacggtcgcaacctatatctccctcttttattacggcacctgggcggcgaagtatctggcgatgcctcaacattattctcatgcagcgatgttactggcgggggtaattacgtttgtgggtgcgctgttggtggggatgctatgtgattcggttgggcgtaaaaagctgattttaatctcccgtgtgatggtgcttctctgtagctggccgtcattctggctgttggtgaattacccaagccctggcatgttgctgacggtggttttcgtgatggtcagctttaccacgcttggcggtgtgccagtgatgttgttgatctctgaactgttgccgaaacggattcgggcattaggtttcgcgctggtttatagcattggcgtagcaatctttggcggttttgcgcaatatttcgccacgcaatccatcgtgttgctggatagtctgacggctccggcgtggtatctggggggaggcacgttgctgtcgatgctggcgttgttgtacgtaaaagaaccggccaaagaattgcagtaaatatgttttattgcgttaccgttcattcacaacactggagcaatccagtatgttcattctctggtatagtgccagcagtacttttggcaaggattcagacatcgtgatgggcgtaagagcgcaacaaaaagaaaaaacccgccgttcgctggtggaagccgcatttagccaattaagtgctgaacgcagcttcgccagcctgagtttgcgtgaagtggcacgagaagcaggcattgctcccacctctttttatcggcatttccgcgacgtagacgaactgggtctgaccatggttgatgagagcggtttaatgctacgccaactcatgcgtcaggcgcgtcagcgtatcgccaaaggcgggagtgtgatccgcacctcggtctccacatttatggagttcatcggtaataatcctaacgccttccggttattattgcgggaacgctccggcacctccgctgcgtttcgtgccgccgttgcgcgtgaaattcagcacttcattgcggaacttgcggactatctggaactcgaaaaccatatgccgcgtgcgtttactgaagcgcaagccgaagcaatggtgacgattgtcttcagtgcgggggccgaggcgttggatgtcggcgtcgagcaacgccggcaattagaagagcgactggtactgcagctgcgaatgatttcgaaaggggcttattactggtatcgccgtgaacaagagaaaaccacaattattccgggaaatgtgaaggacgagtaatgaaacaagcaaatcaagatagaggtacgctgctgctagcgttggttgctggcttatcgatcaatggtacttttgcagcgctgtttagctccattgtaccattttctgtattcccgattatttccctggtgttgacagtttactgcctgcatcaacgttatcttaatcgcactatgccggtaggcttgccgggtctggcagctgcttgttttattctcggcgtactgctgtacagcacggtagttcgtgcggaatatccggatatcggctctaacttcttcccggcagtactgtccgtcattatggtgttctggattggcgcgaagatgcgtaaccgtaagcaggaagttgctgagtaatcggtatcatgccggatgcaagcgcatccggcatgggttttacttcgcggtcagtaatacgccgcactccatatggtgcgtgtaggggaactgatcaaatagagccagacgttcgaccttgtgcgtctggcttaatgtttccagattcttgcataacgtttccggattgcaggagatatacagaatacgtggatacgcctgcaccattttctcggtttcactgtccagaccgctgcgcggtgggtcgacaaaaatggtttcgcactgataactctttaagtcgattccttgcaggcggttaaactcgcgcacaccattcatcgcctgagtaaattcttctgccgccatacgaataatttgtacgttatcaatatggttagcggcaatgttgtattgcgcggcggcgactgacggcttggcgatttcggtggctaatacccgatcaaaattgcgtgccagcgctaatgaaaagttaccgttgccgcagtatagctccagtaaatcgccttttgagcctttggttacgtccagcgcccattccagcatctgaatattcatcgccgcgttcggttgggtaaagctgttttctacctgacggtagatcatctctttccccgcgatcggcagacgttcgtcgatgtaatcctgatccagcgcgattttggttttcgttgcccgaccaatcagatgcacattcagattctgcgcgcgcagtgcatcgcgcagggcttccgcctgctgacgccactcatcatccagctttttatggtacagcaaggaaacaaccgcttgattgcttagcgtagtgaggtaatcaatctggaacaacttgtggcgcagaatgggattattacgcacacccgcaatcatcgccgtcatcaactggttgataagttcactggcggcggggaagctatccacacggatacgacttttggtttgttgatcgaaaatgatgtggtacaggtcatcgccatcgtgccagatgcggaactccgcacgcatccgataatgactgaccggcgagcgaaacacttccggaaccaggtcagaaaacggtgccatcatactttgcaaacgtaccactttttcggctaactgcgcttcatactgttctgttggaaggtgttcgggggtcatgatgtatcctgaaaaattaaagtacgcggcgattgtagggattgctcatcagatgtccagatcttgatgaattcctatttgtgagctacgtctggacagtaacttgttacaacctgtagcatccacttgccggtcctgtgagttaatagggaatccagtgcgaatctggagctgacgcgcagcggtaaggaaaggtgcgatgattgcgttatgcggacactgccatccggtgggaagtcatcatctcttagtatcttagatacccctccaagcccgaagacctgccggccaacgtcgcatctggttctcatcatcgcgtaatattgatgaaacctgcggcatccttcttctattgtggatgctttacaatgattaaaaaagcttcgctgctgacggcgtgttctgtcacggcattttccgcttgggcacaggataccagcccggatactctcgtcgttactgctaaccgttttgaacaaccgcgcagcactgtgcttgcgccaactactgttgtgacgcgtcaggatatcgaccgctggcagtcgacctcggtcaatgatgtgctgcgccgtcttccgggcgtggatatcacccaaaacggcggttcaggtcagctctcatctatttttattcgcggtacaaatgccagtcatgtgttggtgttaattgatggcgtccgcctgaatttggcgggggtgagtggttctgctgatcttagtcagttccctattgcgcttgtccagcgtgttgaatatatccgtgggccgcgctccgctgtttatggttcagatgcaataggcggggtcgtgaatatcatcacgacgcgcgatcaccccggaacggaaatttcagcagggtggggaagcaatagttatcagaactatgatgtttctacacagcaacaactgggggataagacacgggtaacgctgttgggcgattatgcccatactcatggttatgatgttgtcgcctatggtaataccggaacgcaagcgcagccagataacgatggttttttaagtaaaacgctttatggcgcgctggagcataattttactgatgtctggagcggctttgtgcgcggctatggctatgataatcgtaccaattatgacgcatattattctcccggcttgccactggtcgatacccgtaaactctatagccaaagttgggatgccggactgcgctataacggcgaactgattaaatcacaactgattaccagctacagccatagcaaagattacaactacgatccgcattatggtcgttatgattcgtccgcgacgctcgatgagatgaaacagtacaccgtccagtgggcaaacaacatcatcattggccacggtaatattggtgcgggtgttgactggcagaagcagagcacggcaccgggcacagcttatgttgaggatggatatgatcaacgtaataccggcatctatctgactgggctgcaacaagtcggcgattttacttttgaaggcgcaggacgcagcgacgataattctcagtttggtcgtcatggtacctggcaaaccagcgccggttgggagttcatcgaaggttatcgctttattgcttcctacggaacatcttataaggcaccaaatcttgggcaactgtatggcacctacggtaatccgaatctgaatcctgagaaaagcaaacaatgggaaggcgcgtttgaaggcttaactgctggggttaactggcgtatttccggatatcgtaacgatgtcagtgacttgatcgattatgatgatcacaccctgaaatattacaacgaagggaaagcgcggattaagggtgtcgaggcgaccgctaattttgataccggaccactgacgcatactgtgagttatgattatgttgatgcgcgcaatgcaattactgacacgccgttgttacgccgtgctaaacagcaggtgaaataccagctcgactggcagttgtatgacttcgactgggggattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctgaaccacgtcccaccgtgctggtgtttgactccggcgtcggtgggttgtcggtctatgacgagatccggcatctcttaccggatctccattacatttatgctttcgataacgtcgctttcccgtatggcgaaaaaagcgaagtgtttattgttgagcgagtggtggaaattgtcaccgcagtgcaagaacgttatccccttgcgctggctgtggtcgcttgcaacaccgccagtaccgtttcacttcctgcattacgcgaaaagttcgacttcccggttgttggtgtcgtgccggcgattaaacctgctgcacgtctgacggcaaatggcattgtcggattactggcaacccgcggaactgttaaacgttcttatactcatgagctgatcgcgcgtttcgctaatgaatgccagatagaaatgctgggctcggcagagatggttgagttggctgaagcgaagctgcatggcgaagatgtttctctggatgcgctaaaacgtatcctacgcccgtggttaagaatgaaagagccgccagataccgttgtactggggtgtacccatttccctctactacaagaagaactgttacaggtgctgccagagggaacccggctggtggattctggcgcagcgattgctcgccgaacggcctggctgttagaacatgaagccccggatgcaaaatctgccgatgcgaatattgccttttgtatggcaatgacgccagaagctgaacaattattgcccgttttacagcgttacggcttcgaaacgctcgaaaaactggcagttttaggctgatttggttgaatgttgcgcggtcagaaaattattttaaatttcctcttgtcaggccggaataactccctataatgcgccaccactgacacggaacaacggcaaacacgccgccgggtcagcggggttctcctgagaacttcggcagagaaagcaaaaataaatgcttgactctgtagcgggaaagcgtatcatgcacaccccgcgccgctgagaaaaagcgaagcggcactgctctttaacaatttatcagacaatctgtgtgggcactcgaagatacggattcttaacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataacgtcgcaagaccaaagagggggaccttagggcctcttgccatcggatgtgcccagatgggattagctagtaggtggggtaacggctcacctaggcgacgatccctagctggtctgagaggatgaccagccacactggaactgagacacggtccaaactcctacgggaggcagcagtggggaatattgcacaatgggcgcaagcctgatgcagccatgccgcgtgtatgaagaaggccttcgggttgtaaagnnnnncattccattcattaattaattaatgaatgaatgnnnnncatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctctttatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggtaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaagattttcagcctgatacagattagattaaccggcgacaagcgggttaatgaaacagaatttgcctggcggccttagcgcggtggtcccacctgaccccatgccgaactcagaagtgaaacgccgtagcgccgatggtagtgtggggtctccccatgcgagagtagggaactgccaggcatcaaatttagcgaaaggcccagtcggaagactgggcctttttgcgtttctataaactcttcctgtcgtcatatctacaagccatccccccacagatacggtaaactagcctcgtttttgcatcaggaaagcagctatgaaccactccttaaaaccctggaacacatttggcattgatcataatgctcagcacattgtatgtgccgaagacgaacaacaattactcaatgcctggcagcatgcaaccgcagaaggacaacccgttcttattctgggtgaaggaagtaatgtactttttctggaggactatcgcggcacggtgatcatcaaccggatcaaaggtatcgaaattcatgatgaacctgatgcgtggtatttacatgtaggagccggagaaaactggcatcgcctggtaaaatacactttgcaggaaggtatgcctggtctggaaaatctggcattaattcctggttgtatcggctcatcacctatccagaatattggtgcttatggcgtagaattacagcgagtttgcgcttatgttgattgtgttgaactggcgacaggcaagcaagtacgcttaactgccaaagagtgccgttttggctatcgagacagtatttttaaacatgaataccaggatcgcttcgccattgtagccgtaggtctgcgtctgccaaaagagtggcaacctgtactgacgtatggtgacttaactcgcctggatccttcaacggtaacgccacagcaagtatttgatgcggtgtgtcatatgcgcaccaccaaactccctgatccaaaagtgaacggtaatgcgggtagtttcttcaaaaatcctgttgtttctgccgaaactgctaacgcgttgttggcacaatttccaacagccccacattacccccaggtggatggttcagtaaaactggccgcgggttggcttattgatcagtgccagcttaaagggacgcaaattggtggggctgcggtacaccgtcaacaggcgctggttctcataaatgagcacgatgcaaaaagcgaagatgttgtacagctggcgcatcatgtaagacaaaaagtgggtgaaaaatttaatgtctggcttgagcctgaagtccgctttattggtgcatcaggtgaagtgagcgcagtggagacaatttcatgaaggataacaccgtgccactgaaattgatcgccctgttagcgaatggcgaatttcactctggcgagcagttgggtgaaacgctgggaatgagccgggcggctattaataaacacattcagacactgcgtgactggggcgttgatgtatttactgttccgggtaaaggatacagcttgcccgagccaatccagttacttaatgccgaaaagatattgagtcagctggatgacggcagtgtagccgtgctgccagttattgactccacgaatcagtatctcctggaccgcatcggagagcttaaatctggcgatgcctgtgttgcagaataccagcatgctggccgtggtcgtcgtggtcggaaatggttttcgccttttggcgcgaacttatatttgtcgatgttctggcgtctggaacagggcccggcggcggcgattggtttaagtctggttatcggtatcgtgatggcggaagtattacgcaagctgggtgcagataaagttcgtgttaaatggcctaatgacctctatctgcaggatcgcaagctggcaggcattcttgtggagctgactggcaaaaccggcgatgcggcgcaaatagtcattggtgcagggatcaacatggcaatgcgtcgtgttgaagagagtgtcgttaatcaagggtggatcacgctgcaggaagccgggatcaatctcgatcgtaatactcttgcggccatgctgatacgtgaattacgcgcggcgctggaactcttcgagcaagaaggattgacaccttatctttcgcgctgggaaaagttggataattttattaatcgcccagtgaaacttatcattggtgataaagaaatatttggcatttcacgcggaatagacaaacagggtgctttattacttgagcaggatggaataataaaaccctggatgggcggtgaaatatccctgcgtagtgcagaaaaataagaaaggggagcattaactcccctttaaattatttgcgtagtctgacctcttctactgcatgattagcacttttcgtcaggattaaactggcacgctcgcgagtaggtagaatattttgctttaagttcagccagttgatctctttccacaatgtcatggcagtcttaatagcttcttctttagttaatttcgcgtagttatgaaaataggaatccgggtctgtaaaagccccttcgcggaatttcagaaaacggttgatataccacgtctgaagtaagtcttccggtgcatcaacatatatcgaaaaatcgacaaaatcagaaacaaatacatgatgtggatcgtgtggataatccatcccgctctgtaagacatttaacccttcaagaattaaaatatcaggctgaacaacagttttatctccatccgggatcacatcataaataagatgcgagtaaacaggggctgtaacgtttggcacgccggatttgagatcggaaacaaacttcaccaggcgatgcatatcatacgattccgggaagcctttcttcttcatcagaccacgttctttcagaacctgattagggtgaaggaagccatctgtagtgatcagttcaacacgacgatgttccggccaacggcttaatagcgcctgcaatacacgggcggttgtacttttccccaccgcgacactaccagcaatactgataatgtaaggaatgcgttgcccgttggtaccaagaaactgttccagaactgcctgacggcgcagattcgagcttatatagaagttcagcaaacgtgacagaggtaaatagatctcggcaacttcttctaacgagagatcttcattaatacctttgagacgggcgatctcatcttccgataacgtcataggtacggaatcacgcagagctgcccactggttgcggtcaaactgtaggtaaggcgtcattaacgtttgctcttttatactcataagcatgtttctggcggtcatagctctatcggcaaagcgatatttgccatggcgcgtcacagttctgttgaatgggttaatgggcaggagggtaacaccagatggggaggaataataagaaaaaatctctcccaggaagctatcgttgaaaagcaatgtgacagatattccatctgataaaaagaattatggtttagcaggagcacattgttgagcacaatgatgttgaaaaagtgtgctaatctgccctccgttcggctgtttcttcatcgtgtcgcataaaatgtgaccaataaaacaaattatgcaattttttagttgcatgaactcgcatgtctccatagaatgcnnnnncattccattcattaattaattaatgaatgaatgnnnnnaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcgcacgtagactgcccggggcacgccgactatgttaaaaacatgatcaccggtgctgctcagatggacggcgcgatcctggtagttgctgcgactgacggcccgatgccgcagactcgtgagcacatcctgctggggcgtcaggtaggcgttccgtnnnnncattccattcattaattaattaatgaatgaatgnnnnnaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcgcacgtagactgcccggggcacgccgactatgttaaaaacatgatcaccggtgctgctcagatggacggcgcgatcctggtagttgctgcgactgacggcccgatgccgcagactcgtgagcacatcctgctggggcgtcaggtaggcgttccgtnnnnncattccattcattaattaattaatgaatgaatgnnnnnaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggtgtagagatggtaatgccgggcgacaacatcaaaatggttgttaccctgatccacccgatcgcgatggacgacggtctgcgtttcgcaatccgtgaaggcggccgtaccgttggcgcgggcgttgtagcaaaagttctgagctaattgccgataacatttgacgcaatgcgcactaaaagggcatcatttgatgccctttttgcacgctttcgtaccagaacctggctcatcagtgattttctttgtcataatcattgctgagacaggctctgttgagggcgtataatccgaaaagctaatacgcgtttcgatttggtttgcctcgcgatcgcggggtgaaaatgtttgtagaatacttctgacaggttggtttatgagtgcgaataccgaagctcaaggaagcgggcgcggcctggaagcgatgaagtgggtcgttgtggtggcattgctcctggtagcgattgtcggcaactacctttatcgcgacattatgctgccgctgcgtgcgctggccgtagtaattctgattgctgcagcgggtggtgtcgcgctgttaacgacaaaaggtaaagcaaccgttgcttttgcccgtgaagcgcgtaccgaagtccgtaaggtcatttggccgactcgccaggaaacattgcacaccacgctgattgtggctgcggttaccgcagtaatgtcactgatcctgtggggactggatggtattctggttcgcctggtatcctttatcactggcctgaggttctgagatgtctgaagctcctaaaaagcgctggtacgtcgttcaggcgttttccggttttgaaggccgcgtagcaacgtcgctgcgtgagcatatcaaattacacaacatggaagagttgtttggtgaagtcatggtaccaaccgaagaagtggttgaaatccgtggcggtcagcgtcgcaaaagcgaacgtaaattcttccctggctacgtcctcgttcagatggtgatgaacgacgcgagctggcacctggtgcgcagcgtaccgcgtgtgatgggcttcatcggcggtacttccgatcgtcctgcgccaatcagcgataaagaagtcgatgcgattatgaaccgcctgcagcaggttggtgataagccgcgtccgaaaacgttgtttgaaccgggtgaaatggtccgtgttaatgatggtccgttcgctgacttcaacggcgttgttgaagaagttgattacgagaaatctcgtctgaaagtgtctgtttctatcttcggtcgtgcgacccctgtagagctggacttcagccaggttgaaaaagcttaacccagcgatcaaaaaagcggcgatttaatcgttgcacaaggcgcgagattggaatacaatttcgcgccttttgtttttatgggccttgcccgtaaaacgattttttatatcacggggagcctctcagaggcgttattacccaacttgaggaatttataatggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcactgtttacgctgaccgttctttcactttcgttaccaagactccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaagaaatggctaaactgaccaagcgcatgcgtgttatccgcgagaaagttgatgcaaccaaacagtacgacatcaacgaagctatcgctctgctgaaagaactggcgactgctaaattcgtagaaagcgtggacgtagctgttaacctcggcatcgacgctcgtaaatctgaccagaacgtacgtggtgcaactgtactgccgcacggtactggccgttccgttcgcgtagccgtatttacccagggtgcaaacgctgaagctgctaaagctgcaggtgctgaactggtaggtatggaagatctggctgaccagatcaagaaaggcgaaatgaactttgacgttgttattgcttctccggatgcaatgcgcgttgttggccagctgggccaggttctgggtccgcgcggcctgatgccaaacccgaaagtgggtactgtaacgccgaacgttgctgaagcggttaaaaacgctaaagctggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctctaccaccatgggtgcaggtgttgcagttgaccaggctggcctgagcgcttctgtaaactaatgcctttacgtgggcggtgattttgtctacaatcttacccccacgtatgctaacgaaagttagcagctaaaaagatttgttcgttggagcctggcctatccaggcctccgtcgaagaccgcaggagtttcgcaagaaacttaatcccctgcgtagacggtgacagaacgctaagattattcttttatattctggcttgtttctgctcaccgtaattaagacgctctctccgtttggaggagtgaagtgagttccagagattttctctggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagatgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaatcgcagttatctttttaacgcattcgcttacgtataaacttattctgatattcaggaacaatttaaatgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggttgaatctgcaccggctgctctgaaagaaggcgtgagcaaagacgacgcagaagcactgaaaaaagctctggaagaagctggcgctgaagttgaagttaaataagccaacccttccggttgcagcctgagaaatcaggctgaatggctggtgactttttagtcaccagccttttttgcgctgtaaggcgccagtagcgtttcacactgtttgactactgctgtgcctttcaatgcttgtttctatcgacgacttaatatactgcgacaggacgcccgttctgtgtaaatcgcaatgaaatggtttaagcgtgatagcaacaggcattgcggaaagtgttccattttccggtcaacaaaatagtgttgcacaaactgtccgctcaatggacagatgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacggacaacggtacctttgttatcaacggtactgagcgtgttatcgtttcccagctgcaccgtagtccgggggtcttttttgactccgacaaaggtaaaacccactcttcgggtaaggtgctgtataacgcgcgcatcatcccttaccgtggttcctggctggacttcgaattcgatccgaaggacaacctgttcgtacgtatcgaccgtcgccgtaaactacctgcgacaatcattctgcgtgccctgaactacaccacagagcagatcctcgacctgttctttgaaaaagttatctttgaaatccgtgataacaagttgcagatggaactggtgccggaacgcctgcgtggtgaaaccgcatcttttgacatcgaagctaacggtaaagtgtacgtagaaaaaggccgccgcattactgcgcgccatattcgccagctggaaaaagacgacgtcaagctgatcgaagttccggttgagtacatcgcaggtaaagtggttgctaaagactacattgatgagtctaccggcgagctgatctgcgcagcgaacatggagctgagcctggatctgctggctaagctgagccagtctggtcataagcgtatcgaaacgctgttcaccaacgatctggatcacggcccatatatctctgaaaccttacgtgtcgacccaactaacgaccgtctgagcgcactggtagaaatctaccgtatgatgcgccctggcgagccgccgactcgtgaagctgctgaaagcctgttcgagaacctgttcttctccgaagaccgctatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagttgatgatatcgaccacctcggcaaccgtcgtatccgttctgttggcgaaatggcggaaaaccagttccgcgttggcctggtacgtgtagagcgtgcggtgaaagagcgtctgtctctgggcgatctggataccctgatgcctcaggatatgatcaacgccaagccgatttccgcagcagtgaaagagttcttcggttccagccagctgtctcagtttatggaccagaacaacccgctgtctgagattacgcacaaacgtcgtatctcggcactcggcccaggcggtctgacccgtgaacgtgcaggcttcgaagttcgagacgtacacccgactcactacggtcgcgtatgtccaatcgaaacccctgaaggtccgaacatcggtctgatcaactccctgtccgtgtacgcacagactaacgaatacggcttccttgagactccgtatcgtaaagtgaccgacggtgttgtaactgacgaaattcactatctgtctgctatcgaagaaggcaactacgttatcgcccaggcgaactccaacctggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgtgctgataagccgctggttggtacgggtatggaacgtgctgttgccgttgactccggtgtaactgcggttgctaaacgtggtggtgtcgttcagtacgtggatgcttcccgtatcgttatcaaagttaacgaagacgagatgtatccgggtgaagcaggtatcgacatctacaacctgaccaagtacacccgttctaaccagaacacctgtatcaaccagatgccgtgtgtgtctctgggtgaaccggtagaacgcggcgacgtgctggcagacggtccgtccaccgatctcggtgaactggcgcttggtcagaacatgcgcgtagcgttcatgccgtggaatggttacaacttcgaagactccatcctcgtatccgagcgtgttgttcaggaagaccgtttcaccaccatccatattcaggaactggcgtgtgtgtcccgtgataccaagctggggccggaagagatcaccgctgacatcccgaacgtgggtgaagctgctctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcgtctgacgttaaagactcttctctgcgcgtaccaaacggtgtatccggtacggttatcgatgttcaggtctttactcgcgatggcgtagaaaaagacaaacgtgcgctggaaatcgaagaaatgcagctcaaacaggcgaagaaagacctgtctgaagaactgcagatcctcgaagcgggtctgttcagccgtatccgtgctgtgctggtagccggtggcgttgaagctgagaaactcgacaaactgccgcgcgatcgctggctggagctgggcctgaccgacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggccgtcatggtaacaagggtgtaatttctaagatcaacccgatcgaagatatgccttacgatgaaaacggtactccggtagacatcgtactgaacccgctgggcgtaccgtctcgtatgaacattggtcagatcctcgaaacccacctgggtatggctgcgaaaggtatcggcgacaagatcaacgccatgctgaaacagcagcaagaagtcgcgaaactgcgcgaattcatccagcgtgcgtacgatctgggcgctgatgttcgtcagaaagttgacctgagtaccttcagcgatgaagaagttatgcgtctggctgaaaacctgcgcaaaggtatgccaatcgcaacgccggtcttcgacggtgcgaaagaagcagaaattaaagagctgctgaaacttggcgacctgccgacttctggtcagatccgcctgtacgacggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatatggcgcagcatacaccctgcaggaaatgctcaccgttaagtctgatgacgtgaacggccgtactaagatgtataaaaacatcgtggacggcaaccatcagatggagccgggcatgccagaatccttcaacgtattgttgaaagagattcgttcgctgggtatcaacatcgaactggaagacgagtaattctcgctcaaacaggtcactgctgtcggggtaaaacccggcagcggattgtgctaactccgacgggagcaaatccgtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggtgttgaagtgacccagactaaagtacgccgtgagcgtatgggccacatcgaactggcttccccgactgcgcacatctggttcctgaaatcgctgccgtcccgtatcggcctgctgctcgatatgccgctgcgcgatatcgaacgcgtgctgtactttgaatcctatgtggttatcgaaggcggtatgaccaatctggagcgtcagcagatcctgactgaagaacagtatctggacgcgctggaagagttcggtgacgaattcgacgcgaagatgggtgcggaagcaatccaggccctgctgaagagcatggatctggagcaagagtgtgaacagctgcgtgaagagctgaacgaaaccaactccgaaaccaagcgtaagaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgtctgctggatctggctgcgccggacatcatcgtacgtaacgaaaaacgtatgctgcaggaagcggttgacgccctgttggataacggtcgtcgcggtcgtgcgatcactggttctaacaagcgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcactggaactgttcaaaccgttcatctacggcaagctggaactgcgtggtcttgctaccaccattaaagctgcgaagaaaatggttgagcgcgaagaagctgtcgtttgggatatcctggacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgtactgggtctgtactacatgacccgcgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgctaacggtgaattagtagcgaaaaccagcctgaaagacacgactgttggccgtgccattctgtggatgattgtaccgaaaggtctgccttacaccatcgtcaaccaggcgctgggtaaaaaagcaatctccaaaatgctgaacacctgctaccgcattctcggtctgaaaccgaccgttatttttgcggaccagatcatgtacaccggctttgcatatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgttattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtactcatgaaggtatcatgatgactccggttatcgaaggtggtgacgttaaagagccgctgcgcgatcgcgtactgggtcgtgtaactgctgaagacgttctgaagccgggtactgctgatatcctcgttccgcgcaacacgctgctgcacgaacagtggtgtgacctgctggaagagaactctgtcgacgcggttaaagtacgttctgttgtatcttgtgacaccgactttggtgtatgtgcgcactgctacggtcgtgacctggcgcgtggccacatcatcaacaaaggtgaagcaatcggtgttatcgcggcacagtccatcggtgaaccgggtacacagctgaccatgcgtacgttccacatcggtggtgcggcatctcgtgcggctgctgaatccagcatccaggtgaaaaacaaaggtagcatcaagctcagcaacgtgaagtcggttgtgaactccagcggtaaactggttatcacttcccgtaacaccgaactgaaactgatcgacgaattcggtcgtaccaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggtcagaccattacgcgtcagaccgacgaattgaccggtctgtcttcgctggtggttctggattccgcagaacgtacagcaggtggtaaagatctgcgtccggcactgaaaatcgttgatgctcagggtaacgatgtactgatcccgggtaccgatatgcctgcgcagtacttcctgccgggtaaagcgattgttcagctggaagatggcgtacagatcagctctggtgacaccctggcgcgtattccgcaggaatccggcggtaccaaggacatcaccggtggtctgccacgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgtgactcgttacatcgttaacgaagtacaggacgtataccgtctgcagggcgttaagattaacgataaacacatcgaagttatcgttcgtcagatgctgcgtaaagctaccatcgttaacgcgggcagctccgacttcctggaaggtgaacaggttgaatactctcgcgtcaagatcgcaaaccgcgaactggaagcgaacggcaaagtgggtgcaacttactcccgcgacctgctgggtatcaccaaagcgtctctggcaaccgagtccttcatctccgcggcatcgttccaggagaccactcgcgtgctgaccgaagcagccgttgcgggcaaacgcgatgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggcggttctgataacgagtaatcgttaatccgcaaataacgtaaaaacccgcttcggcgggtttttttatgggtgttattcagagggcaattcttcacggaatttttaagaaaggcagggcgaaacgaggaagaagcttttcgccctggacaacattcctgctgacgggactaccataaaaaaacacaacgctttcaacaaccttgcgtttttcatcttccgtagcggctcggaataaatttacgttcttacattctgtctcatggcctttgcgatgggcgtcccagatagctgtcccagtctttccataccggctgcaaaccctgagcggttaacgcggcagcaaccgcttccggtctgcgatcgtcgtgcggtgagaactgttccagctcggggtggttgtcggcatagccacctggctgcgttttcgaaaaagcgctgacgttattaattgccagcggaatcacgcgatcgcgaaaccacggtgattcccgcgtggagagtgacagttcaatctccggtgcaagcagccggaaagcgcagatggcttgcactaactggcgttcatccataatcgacgcaggctcaatgccgccagtacatggacgcaggcgtgggaaggagacagagtagcggctttgccagtaatgctgttgcagccatagcaaatgttcgacaaccatatagcagtcaactcgccagctgtcggaaaggccgattagcgcgccgaggcctatcttatcaatccccgcacgccctagccgatccggcgtttccagccgccagaagaagtcctgttttttacctttcagatgatgatgggcataagtcgcctcatgatatgtctcctgataaaccattactccatcgaggccaagctgttttaactcggcatattccgcctccgccagcggttgcacttccatctgtagtgaagagaactgttcacgcagggcagggagatgacgacgaaagtaatccatccccactttcgcctgatgttcaccagtgactaatagcagatgttcaaagcccatctcccgtatagcggcgctttctctggcaatatccgcttcatccagcgttttgcgcttgatgcggttgctcatagaaaatccgcaataagtacagtcgttagcgcaaagattggaaagataaagcgggacgtagaagctgacgacgttgccaaatcgctgacgagtcagacgttgcgctcgctgggccagtggttccagatagccactggcggcgggtgatagcaatgccatcatgtcgtcgcgggtgagttgcgaggcatttagcgcccgctctacgtcagcagccgttttgccgttgatacgcaggcggatgtcatcccagtccagttgtcgccagcgatcgctgaaggttttcattccgatgcctccagaaatccagtcagcgggctggtggcatgagcaaaatgactgcggctgcccggtccggactgacgtgccagcaggcctgcttctaccgccagacgaaatgccttcgccatgttgacgggatcgtccgcgacggcaatcgccgtattcactaacaccgcgtcggcccccatttccagcgcctgcgcggcatggctgggaacgccgatgccagcatcgacaaccaccggaacggtggcctgctggataataatctccagcatggcgcgggtttccagtccctgattcgagccaatcggcgcgccgagcggcatcaccgctgcacagccgacttcttccagacgtttacacaataccggatcggccccgcagtaaggcagcacgacaaatccctgttgtaccagcttttcggcggctttcagggtttcgatgggatcgggcaacagccagcgggcgtcagggtgaatctctaattttaaccagtttgtgcctaacgcttcacgagccagatgggcggcgaaaatggcttcttccgctgttttcgccccggatgtatttggcagcagggtcacacccgccgcgataagcggttcgaggatagcgtcgttgtgctggcgcaagttgacgcgtttcatcgccagtgtcaccagttggctgccgcaagcgcggatcgcctccatcatcagttgtgaagaggcgaatttccctgtgccggtaaacagatgtgaatcaaacgttttgtccgcaatacgtaacatctcaaccccctgcaataacctgaaaaagcaggatctggtcgccatcctgcacgatatgttgcgcccactgctcacgcgggacgatttgctgattaatcgccagtgccgcgcccgcttgttgttggtcgagttgctccagtagttcgtgaaccgtttgcccggcggcgcactgcatcggttgatcgttaaacaggatctgcattgcttcctccgcataccgggcaaccactggcgcggcgcaaagccaggctgcgccactggctcgacttaccgtcgaacagtcggagttctcccgcaggcgtctctataccacttaataacttaatcgcttccagtgcctgtaaagtgcccataaccccgaccaccgggccaaccacgcccgccgtgcggcagttgcgttctggctcctggttatctggccacaggcagcggtaacatccctgctcccagggcggcgtcagtaccatcaactgaccgccaaatccgaccgcgctggcggtgataagcggcgtgttgagtgccacgcaggtggcattaatctcctggcgagtcgccatattgtcagtacagtcgagcaccacatcggcttgtgcaaccgcatcttttaacgtctcacccgttaatcgttgttgtaatgccatcagttgaatgtcgggattcaactgtgtcagtcgctgttggctgacctgtgatttcgggcgatcgatatcttcagtggtaaagaggatttgtcgttgcagattgcttaaatgcacatcgtcgtcatctgccagtaccagcgtcccgacgccagcccccgccaggtatagcgcagcaggtgtacccagcccgccaagaccaataatcagcacctggctgtcgagcagtttttgctgcccgtccagagcgatatcgtcgagcaggatttggcggctataacgcataaagtcacggtcattcatcgccaactcctgcaatttccagcagctgtgccgttgccaaacgccagtctgcggcttgagtaatggcgctgacgacggcgatactgccgacacccgttgctatcaccgcaggcgcgcgcgccagactgataccgccaatcgccacggtgggataatccgccaggcgctcaacatgccgtgccagctgttccagtccctgcggtgcagaaggcatctgtttggtttgtgtcggaaacacatgtcccagcgcgatataagaaggacgtgccgccagcgcgacgtcgatctccatatcgtcatgggtcgaaacgcccagccgcaggcctgccgcgcggatggcgctgagatcggtggcttgcaaatcttcctgccccagatggacgccatacgcctgatgcttaatcgccagccgccagtaatcgttgataaacaatcgcgcgttatagcggcggcccagcgcaattgccgccaccacatcggcttctacctcttcatcgcgccgatctttgatgcgtagctggagagtacgtacgcctgcatccaacagacgttcgatccactgtacgctgtcaaccaccgggtacagtcctaaacgaaagggtacaggaggaaactcaggctgatacatcacgcttcctccttacgcaggtagatttctccgcctctggcgcggaagttctccgacatatccgccattcccacttcaatggtttgcgcggcggcgtaatcacgcacttcctggctgattttcatcgagcagaatttcggtccacacatggagcaaaaatgggcgactttaccggactcttgcggcagggtttcatcgtgataagcgcgggcagtaaacgggtcgagggccagattaaactggtcttcccagcgaaattcgaagcgggctttcgacatggcgttatcgcgaatttgcgcgcccggatgccctttcgccaggtcggcggcgtgagcggcaatcttataggtgataagcccctgtttaacatcttctttatttggcaggcccagatgctctttcggcgttacgtagcagagcattgcacaaccaaaccagccaatcatcgccgcgccaatccctgacgtgaagtggtcatagcccggcgcgatatcggtagttagcggccccagagtgtaaaacggcgcttcgtggcagtgctctaactcctcggtcatattgcggcgaatcatctgcatcggcacgtggcctgggccttcaatcatcacctgtacgtcatattcccaggcgattttagtcagttcacccagcgtatgcagctcggcaaactgtgcttcatcgttggcgtcctgaatagaaccggggcgcaggccgtcgcccagcgatagcgaaacgtcataagcagcacagatttcacaaatttcgcggaagcgttgatagaggaaattttcctgatgatgggagaggcaccatttcgccataatcgaaccgccgcgagagacgataccggtcaggcgtttcgcggtcatcggcacgtagcgcagcagcacccccgcatggatcgtgaagtaatccacaccttgctcggcttgttccagcagggtgtcgcggaagacttcccaggtaagatcttcagcgatcccgttcaccttctccagtgcctggtagatcggcactgtaccgatcggcaccgggctgttacgcaaaatccactcgcgggtttcgtgaatatagcgaccagtggaaagatccatcacggtatccgctccccagcgtgtggaccataccagtttttccacttcttcttcgatggaagaagtgaccgctgagttgccgatattggcgttaacttttactaggaagttacggccaataatcatcggctccgattccggatgattaatgttggccgggataatcgcacgtccggcagcaacttcatcacggacaaattccgcagtgatattttccggcagacgtgcgccaaagctcattcccggatgctggtggcgtaaaacttcgctacgtatgcgctcgcgacccatattctcgcgaatggcgatgaattccatttctggcgtgatgatacccttgcgggcgtagtgcagttgtgtgacgcggtggcctgctttggcgcgttttggggttaatacgccgctaaaacgcagctcgtcgaggccatcatctgccagccgcgcttttgtgtaatcggaactgcgcacggtaagttcttcggtatcgccgcgcgcatcgatccacggctggcgtagttttgccagcccttgctgcacgttaatggcaatctgcggatcgccatacgggccggaggtgtcgtagaccggaatcgcttcgttttcttcgtactgcggctgttctttgctgccgccaattagcgtcgggctaagctgaatctcacgcatcggcacgcgtacgccggggtgtgtgccagtgatgtaaatgcgttttgagttgggaaaggcggagccttccagggtgtcgataaaatgttgggcctgggcgcgttgttcgcggcgggtcagttttgttgcagacatagctcgttccaaaaagttaaggacgtggcttgtcagacgacggatgaagcaagagacgatcgccgcaaaggcgatgcgatagcagattaactcttgttcccttcgcaggtattagcctgatcaggttccgcggatcccgaataaacggtctcagccagttaaggcactccgacaagaaattagccccacaaacggggcgttgaatgtaaattacgcgttaacagcgcagaactcaagcaggatatttgacgcgggcggcgtcaagcaccagtagaatcagcttatcttccagcacaaagcgcgcttccagtgcctcgccgatgtcagataaaacctgttgaaactcaaggtaattatcatgatcgatggcggtttccagactggaatcgtagtcatccataatctgttgagtattggcttcgagttgtggccaaatcttcgcggcgcgtgcgagttgcccattgccttccagcttatgaagaatgcgctcataaatactgaaatgtccggcagacaagtaatcgaccaggctctgacaaaaatcatcaagggctttttcgtttagcctcatgtacgattctttgccaggcttaatgccaaccagattgtagtaagccacgagcagatgcttacgtacatgtagccagcgatcaaccagtttgttacttcctctgacgcgctccgtcaggttatcgagctggttaagcatgattgactccgcaagtttgtattcaaaaactgctctgtgagaaatgtaaaaaccatgttaaacatgccagtgatgcaaaggtagtgcaagagctatggatcgtataattgaaaaattagatcacggctggtgggtcgtcagccatgaacaaaaattatggttgccgaagggagaattgccatatggcgaagcggcaaatttcgatcttgtgggtcagcgcgcactacaaatcggcgaatggcagggggaacctgtttggttagtacaactgcagcggcgtcacgatatggggtcggtacgtcaggtcattgatctcgatgttgggctgtttcaactggccggacgtggcgtgcaactggcggagttttaccgatcgcataaatactgtggttactgcgggcatgaaatgtatccaagcaaaaccgaatgggcgatgctgtgcagccattgccgtgagcgttactacccgcaaatcgccccctgcattattgttgccatccgtcgcgatgattcgatcctcctcgcccagcatacccgccatcgtaacggtgtccatacagtacttgccggattcgtcgaagtgggtgaaaccctcgagcaggcagtcgcgcgggaagtgatggaagagagcggaattaaagttaaaaacttgcgttacgtgacctcccaaccgtggccgtttcctcagtcgttaatgaccgcgtttatggcggaatatgacagcggcgagatcgtgatcgacccgaaagaattgcttgaggcgcactggtatcgctatgacgatttgccgttactcccgccgcccggcaccgtagcgcgccgtctgatagaagatacagtggcgatgtgtcgggcagagtatgagtgatgatacactgaccgcctgacgcactaaggaacagctaaaatgaccgaacttaaaaacgatcgttatctgcgggcgctgctgcgccagcccgttgatgtcactccagtatggatgatgcgccaggcgggtcgctatctaccggaatataaagccacgcgcgcccaggcgggcgattttatgtcgctgtgcaaaaatgccgagctggcgtgcgaagtgactttgcaaccgctgcgtcgctatccgctggatgcggcgatcctcttttccgatatcctcaccgtgccagacgcgatgggtttagggctctattttgaagccggagaaggtccgcgttttacctcgccagtcacctgcaaagccgatgtcgataaactgccaattccggacccggaagatgagctgggttacgtgatgaacgcggtgcgtaccattcgtcgcgaactgaaaggcgaagtgccgctgattggtttttccggcagcccgtggacgctggcgacttacatggttgaaggcggtagcagcaaagccttcaccgtgatcaaaaagatgatgtatgccgatccgcaggcgctgcacgcgctgctcgataaactggcgaaaagcgtcacgttgtatctgaatgcgcagattaaagccggtgctcaggcagtcatgattttcgacacctggggcggcgtgcttaccgggcgcgattatcaacagttctcgctttattacatgcataaaattgttgatggtttactgcgtgaaaacgacggtcgccgcgtgccagtcacgctgtttaccaaaggtggcggacagtggctggaagcgatggcagaaaccggttgcgatgcgctgggcctcgactggacaacggacatcgccgatgcgcgccgtcgcgtgggcaataaagtcgcgctgcagggtaatatggacccgtcgatgctgtacgcgccgcctgcccgcattgaagaagaagtggcgtctatacttgccggtttcggtcacggcgaaggccatgtctttaaccttggtcacggcattcatcaggatgtgccgccagaacatgcaggcgtgtttgtggaggcagtgcatcgcttgtctgaacagtatcaccgctaaggagcgattatggatctcgcgtcattacgcgctcaacaaattgaactggcttcttctgtgatccgcgaggatcgactcgataaagatccgccggatctgatcgccggagccgatgtcggatttgagcagggcggcgaagtgacgcgagcggcgatggtgctgctgaaatacccctcgcttgagctggtggagtataaagtggcccgcatcgccaccaccatgccttacattcctggttttctctcctttcgtgaatatcctgcgctgctggcagcgtgggagatgctgtcacaaaagccggatttagtgtttgtcgatggtcatgggatctcgcatcctcgccgtcttggcgtcgccagccattttggtttgctggtggatgtgccgaccattggcgtagcgaaaaaacggctctgcggtaaattcgaaccgctctccagcgaaccgggcgcgctggccccgctgatggataaaggcgagcagctggcctgggtctggcgcagcaaagcgcgctgtaacccgttgtttatcgctaccggccatcgggtcagcgtggacagcgcgctggcgtgggtacaacgctgcatgaaaggctatcgtctgccggagccaacgcgctgggcggacgcagtggcctcggaacgtccggcgttcgtgcgctatacagcaaatcagccctaattcaggtaaactgcggataatttccgtatttgagaactcaacatgttacaaaacccaattcatctgcgtctggagcgcctggaaagctggcagcacgtcacttttatggcctgcttatgcgaacgtatgtaccccaattacgccgtattctgtcagcaaaccggcttcggcgatgggcagatttaccgccgcattctcgatctcatttgggaaacgctgaccgtcaaagacgcaaaagtaaatttcgacagccaactggagaaatttgaagaagcgattccttcagccgacgatttcgatctgtacggcgtttatccggcaatcgatgcttgcgtggcgttaagtgaactggtccattcgcgtttaagtggcgaaacgctcgaacacgcggtggaagtgagtaagacttccatcacgaccgtggcgatgctggaaatgactcaggctggtcgcgaaatgagcgatgaagagctcaaagaaaacccagctgtagagcaagaatgggacattcagtgggaaatattccgacttttagctgagtgcgaagaacgcgatatcgagctgataaaaggccttagggcagacctgcgtgaggcgggtgagagcaatattggtataatttttcagcaataagaccagaaaacgtgatttaacgcctgatttgtcgtacctggagtcttccctttcgccccccgtctggtctacatttggggggcgaaaaaaagtggctatcggtgcgtgtatgcaggagagtgctattctggcatttccgtcgcactcgatgcttagcaagcgataaacacattgtaaggataacttatgaacaagactcaactgattgatgtaattgcagagaaagcagaactgtccaaaacccaggctaaagctgctctggagtccactctggctgcaattactgagtctctgaaagaaggcgatgctgtacaactggttggtttcggtaccttcaaagtgaaccaccgcgctgagcgtactggccgcaacccgcagaccggtaaagaaatcaaaattgccgcagctaacgtaccggcatttgtttctggcaaggcactgaaagacgcagttaagtaagattgcgtggcagtgaacagttttaacgaaggggtggtttcaccccttttgtctttctggcgtcgatcattgatgctggctggcgctctgtttctcactgcttgtagtcacaactcttcacttcctccctttaccgccagtggatttgctgaagaccagggcgcggtacgcatctggcgaaaagacagcggcgataatgtgcatctgcttgccgtgtttagcccgtggcgcagtggcgataccacgacgcgagagtatcgctggcagggcgataacctcacgctcatcaatatcaatgtttacagcaaacccccggtgaatattcgcgcgcgttttgacgatcgcggcgatctgagctttatgcaacgcgaatccgatggggaaaagcagcagctttctaacgaccaaatcgatttataccgttatcgtgctgatcagatccgccagattagcgatgccttacgtcaggggagagtcgtgctgcgccaggggcgctggcatgcgatggagcagactgtgaccacctgcgaagggcaaaccattaaacctgatttagattcgcaggcgatagcgcatatcgagcgccgccagagccgctcttctgttgatgtcagcgtggcatggctggaagcgcccgaaggttcgcaattactgttggtggcaaactctgatttctgtcgctggcaacccaacgagaaaacgttctgatttaccagtggcccatacccatatgaccgccaccaccgcagccgccgtaacccattccggtaccgcgcggaatacccgcttcagccatcgcaatatctcgtttcacccgtaactcatctaacgactgacgcaaattctccatctctttggcgagcgcgttaattttgctgctatccggtgggttcgcggctaacagggcattgtattcataacgctttgtcaccagttgctgttgcagtgcgctgctttgagcgtaaaagtcattatggattttctgccacgctgtctgttgttcgctggtcaaaggcgcggcattttgctgccacataccatgtccgccgtgagcaaatgcagatgtcgatcccatcgccattgctgaaagcgccatcattaccagggcaattttcgtgttccgtttcatggttaatcctccagtggttgtcttacttcgggtattgcatcttccgtgccaacggcgaaacgctgatatgacgggtaatctggcatgataaacgagtaaaaatgactcgcctgctgcgggtagcgagtcatttttactcattgaaacttaagcctttgtgttacagctcagggtaagcgctgataaaagatggcatgatttctgctgtcagaaagggatgagcaggcaaagaagaagatgcgttttatgcaacgttctaaagactccttagctaaatggttaagcgcgatcctccccgtggtcattgttgggctggtggggctgtttgcggtgacagtgattcgcgattatgggcgcgagactgccgccgccagacaaacgctgctggaaaaaggcagtgtacttattcgtgctcttgaatccggctcgcgcgtcggcatggggatgcgcatgcatcatgcgcagcagcaggccttacttgaagaaatggccgggcagcctggagtacgttggtttgcggtcacggatgaacaaggaacaatcgtgatgcatagcaactccggcatggtgggaaaacagctttattccccgcaggaaatgcagcagttacatccgggaaatgaagaagcgtggcggcggatcgatagcgcagacggcgagcctgttctggaaatttatcgccagtttcaaccgatgtttgctactggaatgcaccggatgcgccatatgcagcagtatgccgcgacaccacaagcaatttttatcgctttcgacgccagtaacattgtgagtgccgaagatcgtgagcagagaaacaccctgattatcctcttcgccctggcgacggtcttgctggcaagcgtgttgtcattcttctggtatcgccgatatctgcgctcgcggcagctattgcaggatgaaatgaagcgcaaagagaagctggtggcgctggggcatcttgcggcaggtgttgcccacgaaatccgtaacccactttcctcgattaaagggctggcgaaatactttgccgaacgcgcgccagcagggggagaagcgcatcaactggcgcaggtgatggcgaaagaagccgaccgtttaaaccgcgtggtaagcgagctgctggaactggttaagccaacgcatctggctttgcaggcggtggagctcaacacgctgattaaccactcattacagctggtaagccaggatgcaaacagccgggagatccagttacgctttaccgccaacgacacattaccggaaattcaggccgatccggacaggctgactcaggtcctgttgaatctctatctcaacgctattcaggcgattggtcagcatggcgtgattagcgtgacggccagcgaaagcggcgcgggcgtgaaaatcagcgttaccgacagcggtaagggaattgcggcggatcagcttgaagccatcttcactccgtacttcaccaccaaagccgaaggcaccggactggggctggcggttgtgcataatattgttgaacaacacggtggtacaattcaggtcgcaagccaggagggaaaaggcgcaacgttcaccctttggcttccggtcaatattacgcgtaaggacccacaaggatgacgcacgataatatcgatattctggtggtggatgatgacattagccactgcactattttgcaggctttgctgcgcggctggggctataacgtcgcgctggcgaacagcgggcgacaggcgctggagcaggtgcgggaacaggtttttgatcttgtgctttgcgatgtgcgaatggcagagatggatggtatcgccacgctaaaagagatcaaaacattaaaccccgcgattccggtgctgattatgaccgcgtactccagcatcgagacggcggtagaggcgttgaaaaccggggcgctggattatctcatcaagccgctggatttcgataacctacagtcgacgctggaaaaggcgctcgcgcatacacacagtgttgacgctgaaacgcctgcggtgtctgccagccagttcggtatggtcggtaaaagcccggcgatgcaacacctgctcagtgaaatcgccctcgtcgcgccatcggaagccacggtgctgatccacggcgattccggcaccggtaaagagctggtcgccagggcgattcacgccagtagcgcacgtagcgaaaaaccgctggtaacgctcaactgcgcggcgctcaacgaatccttgctggagtctgaattgttcggtcacgaaaaaggggcgtttaccggggccgacaaacgccgggaagggcgctttgttgaggcggacggcggcacgttgtttctcgatgaaattggcgatatctcgccgatgatgcaggtgcgtctgctacgtgcgattcaggagcgcgaagttcagcgtgtcggtagcaaccagactatttcggttgatgtccggctgattgcggcaacccatcgcgatcttgccgcagaggtgaatgccgggcgttttcgccaggatctctactatcggctgaacgtggtggcgattgaagtaccatcgctgcggcaacggcgggaagatattcctctgctggctggccattttcttcagcgctttgccgaacgtaatcgcaaggcggtaaaaggctttacgccccaggcgatggatctgctgattcattacgactggccgggaaatattcgtgaactggaaaacgcggtggaacgggcggtggtgctgctgaccggggaatatatttccgaacgcgagctgccgctggcgattgccagtacgccgatcccgctggtacaaagtcaggatattcagccgctggtggaagtcgaaaaagaggtgattctggcggcgctggagaaaacgggcggcaacaaaaccgaagccgcccgccagttagggatcacgcgcaaaacgctattggcaaaactgtcgcgttagttctgctcgcgttcgatagcgcgccagccgatatctttccggcagaagcagtcgtcccaatggatatcggtcattaaggcataagcgcgtttctgcgcttctgccacggtatgacccagcgcggtaacgcacagtacgcgcccgccgctggtcactacctgctcgtcatccgctagtttcgtgcccgcgtggaacactttgccgtctgccacttcttccagcggcaggccgtggatcacatcgccggtgcggtaatcgcccggatatccacccgcagccatcaccacgccgagagaagcgcgttcatcccactcggacgttttctcgtccagcttgccttcacaggccgccaggcagagctcaaccagatcggacttcatgcgcagcataatcggctgggtttccggatcgccaaagcggcagttaaattcaataaccttcggattgccctgtttgtcgatcatcaggcccgcgtagagaaaaccagtgtaggtgttgccttccgccgccatgcctttcacggttggccagatgatacgctccatcgtgcgctgatgaacctcatcggtcactactggcgcaggggagtaagcgcccatcccgccggtgttcggcccggtatctttatcgcctacgcgtttgtgatcctggctggtggccatcggcagcacatgctcgccgtccaccatcacgataaagctcgcttcttcgccgtcgaggaactcttcgataacaatgcgatgacccgcgtcgccaaacgcgttgcccgccagcatgtcgcgcacggcggcttcagcttcttccagcgtcatcgccacgataacgcctttcccggcggccagaccgtccgctttaatgacgattggcgcgcctttctcacgcagatacgccagcgcaggttctacctcggtgaagttctggtattccgctgtgggaatgttatggcgggccagaaagtctttggtgaatgctttagaaccttccagttgtgcagcacctgcggttgggccgaagattttcagcccggcggcgcggaaggtatcgactacgcctttcaccagcggcgcttccgggccgacgatggttagatctaccttttcgttttgtgcgaaatccagcagcgccgggatatcggttacgccgatagcgacgttctgtagcgcgggttccagcgcagtgcctgcattacccggagcaacaaaaacagtttcaaccagcggcgactgagccgctttccaggccagcgcgtgctcgcgcccgccgttaccaatcactaatactttcatctattgctccattaatggcggaagtggcgcatgtcggtgaagagcatcgcaataccgtgctcgtcggcggcggcaatcacttcgtcatcacggatggaaccgccaggctggattacacaggtcacgcccgcagcggcggcggcatcaataccgtcgcggaacgggaagaacgcgtcagaagccatcgaggaacctttcacttccagaccttcatcggcggctttaataccggcgattttcgcggagtacacgcggctcatctggcccgcgccaataccgatggtcatattgtttttggcatagacgatagcgttggatttcacgaacttcgccactttccagcagaacagcgcatcacgcaattcctgttcggtcggctggcgtttggtgacgacgcgcagttcttctgcaccgaccatccccagatcgcgatcctgaaccagcagaccgccgttcacgcgtttgaaatcaagacccggaacacgctcgccccactgaccgcaggtcagaacgcgtacgttttgcttggcggcggtgattttcagggcttcttcgctggcggacggcgcaataatcacttcgacgaactgacgagaaatgatggcctgcgcggtttcagcatccagttcgcggttaaaggcaatgatgccgccgaatgcggaggttgggtcggttttgtacgcgcgatcgtaagcatcaagaatggaattgccgatagccacgccgcaagggttggcgtgtttcacaatcacacatgccggctcggcgaactctttcacgcactccagcgccgcatcggtgtcggcgatgttgttataagagagggctttaccttgaacctgggttgcagtagcaacggaggcttctttcacattctcttctatatagaaggcagcctgctggtggctgttctcgccgtaacgcatatcctgcttcttaatgaagttcaggttcagcgtgcgtgggaagcgaccggcggcttctttgctttcaccgtggtaagccggaaccatgctgccgaagtagttggcaatcatgctgtcgtaggcggcggtgtgttcgaaggctttgatggcaaggtcaaagcgagtttccagagtcagggagccttcattggcatctatctctttaataatggcgtcgtagtcgctgctcttcaccacgattgcgacatctttatggttcttggcggcagagcgcaccatcgtcgggccgccgatatcgatgttctcaaccgcatcttccagcgagcagccttcacgagcaacggtctgggcgaacggatacaggttaacaaccaccatatcgataggctggatctgatgttcttccataatggtatcgtcctggccgcgacggcccagaattccaccatgtactttcggatgcagggtcttcacgcgtccatccatcatctccgggaaaccggtgtaatcggaaacttcggttaccggcagacctttttctgctaacagacgggctgtgccccctgtagacagcagctccacaccgcgtgcggaaagtgcctgggcgaattcgacgataccggctttgtcagaaacactgagcagagcgcggcggactggacgacgttgttgcatggtaaatcccctggatttgactattacagagagcgttagctgaatttttcgcgaaaaactcagctaacgcccctaacggggcatccttatttttcgcccgcattgtaacgaaaacgtttgcgcaacgctcgcgaatttttctctttcaatggtgatcacaattttgacagtgtttaccgtgggaaaaatacagaaattacattgatgattgtggataactctgtgcgtaaaaaggtataaagcggggttttgctggggaatgcagcagtcagtcatttttctgcaatttttctattgcggcctgcggagaactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgagctgaaagccgcgtcgcaactgctctttaacaatttatcagacaatctgtgtgggcactcgaagatacggattcttgacgtcgcaagacgaaaaatgaataccaagtctcaggagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgttttgctgacgagtggcggacgggtgagtaatgtctgggaaactgcctgatggagggggataactactggaaacggtagctaataccgcataacgtcgcaagaccaaagagggggaccttagggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgcagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgcaagaaacatcttcgggttgtgaggttaagcgactaagcgtacacggtggatgccctggcagtcagaggcgatgaaggacgtgctaatctgcgataagcgtcggtgaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatattgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcctctttatggggtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacactatgtgttgttgggtaggggagcgttctgtaagcctgtgaaggtggcctgtgagggttgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaaccaaggctgaggcgtgatgacgaggcactacggtgctgaagcgacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagcgacttgctcgtggagctgaaatcagtcgaagataccagctggctgcaactgtttattaaaaacacagcactgtgcaaacacgaaagtggacgtatacggtgtgacgcctgcccggtgccggaaggttaattgatggggttagcggtaacgcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttggcccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaagattttcagcctgatacagattagattaaccggcgacaagcgggttaatgaaacagaatttgcctggcggccttagcgcggtggtcccacctgaccccatgccgaactcagaagtgaaacgccgtagcgccgatggtagtgtggggtctccccatgcgagagtagggaactgccaggcatcaaattagaaaaaccccggtcaataaggccggggttttttgcatatcaattatttgcatgatgaagggaatctcatgtcagttctgtatatccaaattcgtcgtaatcaaattactgttcgcgatcttgaaagcaaacgtgaagtgtcaggagatgctgccttcagtaaccagcgcctgttaatcgccaatttctttgttgcagaaaaagttctgcaagatcttgttctgcaactccacccacgttcaacctggcattcttttttgccagcaaaacgtatggatattgttgtgagcgcgctggaaatgaatgagggcggtttgtcacaggttgaggaacgcattcttcatgaagtggtcgcaggggcaacgttaatgaaatatcgccagttccacatccatgcgcaatcagtggtactcagtgatagtgcggtcctggcaatgtttaagcagaaataatcatgtcaccattggtgggtacgaaacctaaagttcagcccaccgggatgagaaaaaaaccgcctacacccccacatatgccagattcagcaatggatacggtttccccaaatcgtccacctcagagcgtcccgtaaccttaaaacccaccttcttatagaacccaaccgcctgctcattttgctcattaacattggttgtcagttccggggccattgagagcgcatgcttcaccagcatccgacccacgccgcagccgcgcacatcaggatcgataaacagcgcatccatatgctgcccacttaacaacataaacccaaccggccgatcccgctcattaaccgcgacccacaacggtgcttccggcagaaaggaatgcaccagctcttccagctcggcccgatactctgctgataaaaaatcgtgagtggcatcgacagaacgacaccaaatcgcaacgagttcctccccctcctcatgccgtgagcgtcgaatactaataaccattttctctccttttcgtcattcttatattctaacgtagccttttccttgaaactttctcaccttcaacatgcaggctcgacattggtaaattttctggttatcttcagctatctggatgtctaaacgtataagcgtatgtagtgaggtaatcaggttatgccgattcgtgtgccggacgagctacccgccgtcaatttcttgcgtgaagaaaacgtctttgtgatgacaacttctcgcgcgtctggtcaggaaattcgtccgctaaaggtgcttatccttaacctgatgccgaagaagatcgaaactgaaaatcagtttctgcgcctgctttcaaactcacctttgcaggtcgatattcagcttttgcgcatcgattcccgtgaatcgcgcaacacgcccgcagagcatctgaataacttctactgtaactttgaagatattcaggaacaaaactttgacggtctgatagttaccggcgcgccgctgggcctggtggagtttaatgatgtcgcttactggccgcagatcaaacaggtgctggagtggtcgaaagatcacgtcacctcgacgctgtttgtctgctgggctgtacaggccgcgctcaatatcctctatggtattcctaagcaaacccgcaccgacaaactctctggcgtttacgagcatcatattctccatcctcatgcgcttctgacgcgtggctttgatgattcattcttggcaccgcattcgcgctatgctgactttccggcagcgttgattcgtgattataccgatctggaaattctggcagagacggaagaaggggatgcatatctgtttgccagcaaagataagcgcattgcctttgtgacgggccatcccgaatatgatgcgcaaacgctggcgcaggaatatttccgcgatgtggaagccgggctagacccggatgtaccgtataactatttcccgcacaatgatccgcaaaatacaccgcgagcgagctggcgtagtcacggtaatttgctgtttaccaactggctcaactattacgtctaccagatcacgccatatgatctacggcacatgaatccaacgctggattaatcttctgtgatagtcgatcgttaagcgattcagcaccttacctcaggcaccttcgggtgccttttttatttccgaaacacacctcagcaagtgaataaattttatttatattgttatcagtaagttaacatgtatttttaattaaaatggaaattgtttttgattttgcattttaaatgagtagtcttagttgtgctgaacgaaaagcgcacaacgatccttcgttcacagtggggaagttttcggatccatgacgaggagctgcacgatgactgaacaggcaacaacaatcgatgaactggcttttacaaggccgtatggcgagcaggagaagcaaattcttactgccgaagcggtagaatttctgactgagctggtgacgcattttacgccacaacgcaataaacttctggcagcgcgtattcagcagcagcaggatatcgataacggaatgttgcctgattttatttcggaaacagcttccattcgtgatgctgactggaaaattcgcgggattccttcggacttagaagatcgtcgcgtagagattaccggacctgtagagcgcaagatggtgatcaacgcgctcaacgccaatgtgaaagtctttatggccgatttcgaagattcactggcaccagactggaacaaagtgatcgatgggcaaattaacctgcgcgatgcggttaacggcaccatcagctatagcaatgaagcaggcaaaatttatcagctcaagcccaatccagcggttttgatttgtcgggtacgcggtctgcacttgccggaaaaacatgtcacctggcgtggtgagacaatccccggtagcctgtttgattttgcgctctatttcttccacaactatcaggcactgttggcaaagggcagcggtccctatttctatctgccgaaaacccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagttatatcaaaacattgaaaaactatcccgatcgcgtcctgccagacagacaggcagtgacgatggataaacccttcctgaatgcttactcacgcctgttgattaaaacctgccataaacgcggtgcttttgcgatgggcggcatggcggcgtttattccaagcaaagatgaagagcgcaataaccaggtgctcgacaaagtaaaagcggataaatcgctggaagccaataacggtcacgatggcacatggatcgctcacccgggccttgctgatacggcaatggcggtattcaacgatattctcggctcccgcaaaaaccagcttgaggtgatgcgcgaacaagacgcgccgattactgccgatcagctgctggcaccttgtgatggtgaacgcaccgaagaaggtatgcgcgccaacattcgcgtggctgtgcagtacatcgaagcgtggatctctggcaatggctgtgtgccgatttatggcctgatggaagatgcggcgacggctgaaatttcccgtacctcaatctggcagtggatccatcatcaaaaaacgttgagcaatggcaaaccggtgactaaagccttgttccgccagatgctgggcgaagagatgaaagtcattgccagcgaactgggcgaagaacgtttctcccatgggcgttttgacgatgccgcacgcttgatggaacagatcaccacttccgatgagttaattgatttcctgaccctgccaggctaccgcctgttagcgtaaaccaccacataactatggagcatctgcacatgaaaacccgtacacaacaaattgaagaattacagaaagagtggactcaaccgcgttgggaaggcattactcgcccgtacagcgcggaagatgtggtgaaattacgcggttcagtcaatccggaatgcaccctggcgcaactgggcgcggcgaaaatgtggcgtctgctgcacggcgagtcgaaaaaaggctacatcaacagcctcggtgcactgactggtggtcaggcgctgcaacaggcgaaagcgggtattgaagcagtctatctgtcgggatggcaggtagcggcggacgctaacctggcggccagcatgtatccggatcagtcgctctatccggcaaactcggtgccagcggtggtggagcggatcaacaatactttccgccgtgcggatcagatccaatggtccgcgggcattgagccgggcgatccgcgctatgtcgattacttcctgccgatcgtcgccgatgcggaggccggttttggcggtgtactgaatgcctttgaactgatgaaagcgatgattgaagccggtgcagcggcagttcacttcgaagatcagctggcatcagtgaagaaatgtggtcacatgggcggcaaagttttggtgccaactcaggaagctattcagaaactggtcgcggcgcgtctggcagctgatgtgacgggcgttccaaccctgctggttgctcgtaccgatgccgatgcggcggatctgattacctccgattgcgacccacatgacagcgaatttattactggcgagcgtaccagtgaaggcttcttccgtactcatgcgggtattgagcaagcgatcagccgtggcctggcgtatgcgccatatgctgacctggtatggtgtgaaacctccacgccggacctggaactggcgcgtcgctttgcacaagccatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactatgttgagaaagtgcagcagccggaatttgccgccgcgaaagatggctataccttcgtatctcaccagcaggaagtgggtacaggttacttcgataaagtgacgaccattattcagggcggcacgtcgtcggttaccgcactgactggctccactgaagaatcgcagttctaacaaccaacgcccctttccgtaaggcgaggggcgaattaaggagaggcgatgccgcgtggcctggaattactgattgcacaaaccattttgcaaggtttcgacgctcagtatggtcgattcctcgaagtgacttccggggcgcagcagcgtttcgagcaagccgactggcatgctgtccagcaggcgatgaaaaaccgtattcatctttacgatcatcacgtgggtctggtcgtggagcaactgcgctgcattactaacggccaaagcacggacgcggcatttttactgcgcgttaaagagcattacacccggctgttgccagattacccgcgcttcgagattgcggagagctttttcaactccgtgtactgtcggttatttgaccaccgctcgcttactcccgagcggctttttatctttagctcccagccagagcgccgctttcgtaccattccacgcccactggcgaaagactttcaccccgatcacggctgggaatctctgctgatgcgcgttatcagcgatctgccgctgcgtctgcgttggcagaataaaagccgtgacattcattacatcgttcgccatctgacggaaacgctggggacagacaacctcgcggaaagtcatttacaggtggcgaacgaactgttttaccgcaataaggcagcctggctggtgggcaaactaataacgccttccggcacgttgccatttttattgccgatccaccagacggacgacggcgagttatttattgatacctgcctgacgacgaccgccgaagcgagcattgtttttggctttgcgcgttcttattttatggtttatgcaccgctgcccgcagcgctggtcgagtggctacgggaaattctgccaggtaaaaccaccgctgaattgtatatggctatcggctgccagaagcacgctaaaaccgaaagctaccgcgaatatctcgtttatctacagggctgtaatgagcagttcattgaagcgccgggtattcgtggaatggtgatgttggtgtttacgttgccgggttttgatcgggtatttaaagtcatcaaagacaggttcgcgccgcagaaagagatgtctgccgctcacgttcgtgcctgctatcaactggtgaaagagcacgatcgcgtgggccgaatggcggacacccaggagtttgaaaactttgtgctggagaagcggcatatttccccggcattaatggaattactgctccaggaagcagcggaaaaaatcaccgatctcggcgaacaaattgtgattcgccatctctatatcgaacgacggatggtgccgctcaatatctggctggaacaagtggaaggtcagcagctgcgcgacgccattgaagagtacggcaatgccattcgccagcttgccgctgccaacatcttccctggggatatgttatttaaaaactttggcgtcacccgtcacgggcgcgtggtgttttatgattacgatgaaatttgctacatgacggaagtgaatttccgcgacatcccgctgccgcgctacccggaagacgaacttgccagcgaaccgtggtacagcgtctcgccgggtgatgttttcccggaagagttccgtcactggttatgtgccgacccgcgtattggtccgctatttgaagagatgcacgccgacttgttccgcgctgattactggcgcgcactacaaaaccgcatacgtgaagggcatgtggaagatgtttatgcgtatcggcgcaggcagcggtttagcgttcgattcgtataaatcagaggcgaaaaagtcagcgtattccaccgtacgacagcgtcacttccttcgccgctttaatcaccatcgcgccaaactcggtcacgcggtcatcggtaatacgtgaaatcggcccggaaattgaaattgcggcaaacggttcgcggtgctcatcgaaaatacacgctgcaaggcaacgcagccccagcgcatgttcctcatcgtcaaatgaataaccccgtttgcgcgtttgggcgagatcttcttttaaatgcacaggagacaccagcgtcgcgtgggtataggcatgtaaccctttgcggtgcagcagcttcgtcacctgttcttcgctcagttgggccagaaaggctttacccgcaccggaagcgtgcatcggcaatttaccgccgataggcgcggacatacgcatcaggtgagtacactgtacctggtcgataataatcgcttcgtgattgctttgatcaagcaccgccatattgaccgtttcgccagactcttccattagattgcgcaggatagggtgaacaatcgctaacaaattacggctctggagaaagctgctaccgaccataaaggcgtgtgcgccgattgcccagtgacccagttcgccgacctgacggacaaagccctgttgctgcatcgtggttagcaggcggtgggtcgtggaattgggtaacccggcttgctgtgccagttccgtgagtgccacactgccattggattcggcaatccactccagtaatttcaggccacgcgttaaagactgaacctgtccagtcgctggtgcggtggcaacggcgggttttctgccgcgttttgcgggaatgggtgcgaccatgacagtctcctttttctgtatcgtggaaatcattttcatttttattatcagcgaatgcaatagttgctgaacagatccgatgagttaatgttgaacaaatctcatgttgcgtggtggtcgcttttaccacagatgcgtttatgccagtatggtttgttgaatttttattaaatctgggttaagcgtgtcgggagcaagtgtgagcagcaaagtggaacaactgcgtgcgcagttaaatgaacgtattctggtgctggacggcggtatgggcaccatgatccagagctatcgactgaacgaagccgattttcgtggtgaacgctttgccgactggccatgcgatctcaaaggcaacaacgacctgctggtgctcagcaaaccggaagtgatcgccgctatccacaacgcctactttgaagcgggcgcggatatcatcgaaaccaacaccttcaactccacgactattgcgatggcggattaccaaatggaatccctgtcggcggaaatcaactttgcagcggcgaaactggcgcgcgcctgtgccgacgagtggactgcccgcacgccggagaaaccgcgctacgttgccggtgttctcggcccgaccaaccgcacggcgtctatttctccggacgtcaacgatccggcattccgcaacatcacttttgaccagctggtggcggcttatcgagaatccaccaaagcgctggtggaaggtggcgcggacctgatcctgattgaaaccgttttcgacacccttaacgccaaagcggcggtctttgcggtgaaaacggagtttgaagcgctgggcgttgagctgccgattatgatctccggcaccatcaccgacgcctccgggcgcacgctctccgggcagaccactgaagcgttttacaactccctgcgccacgccgaagcgctgacctttggcctgaactgtgcgctggggccagacgaactgcgccagtacgtacaggaactgtcgcgtattgcggaatgctatgtcaccgcccacccgaacgccgggctgcccaacgcctttggtgaatacgatctcgacgccgacacgatggcaaaacagatacgtgaatgggcagaagcgggctttctcaatatcgtcggcggctgctgcggcaccacgccacaacatattgcagcgatgagtcgtgcagtagaaggattagcgccgcgcaaactaccggaaattcccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcgctggatgtggcgcgtcagcaggtggaaaacggtgcgcagattatcgatatcaacatggatgaagggatgctcgacgccgaagcggcgatggtgcgttttctcaatctgattgccggtgaaccggatatcgctcgcgtgccgattatgatcgactcctcaaaatgggacgttattgaaaaaggtctgaagtgtatccagggcaaaggcattgttaactctatctcgatgaaagagggtgtcgacgcctttatccatcacgcgaaactgttgcgtcgctacggtgcggcagtagtggtaatggcttttgacgaacagggccaggccgatacccgcgcacggaaaatcgagatttgccgtcgggcgtacaaaatcctcaccgaagaggttggcttcccggctgaagatatcatcttcgacccgaacatcttcgcggtcgcaactggcattgaagagcacaacaattacgcacaggactttatcggcgcgtgtgaagacatcaaacgtgaactgccgcacgcactgatttccggcggcgtttctaacgtgtcgttctcgtttcgtggcaacgatccggtgcgcgaagccattcacgcggtgttcctctactacgctattcgcaatggcatggatatggggatcgtcaacgccgggcaactggcgatttacgacgacctgcctaccgaactacgcgacgcggtggaggatgtgatcctcaaccgtcgcgacgatggcaccgagcgtttactggagcttgccgagaaatatcgcggcagcaaaaccgacgacaccgctaacacccagcaggcggagtggcgctcgtgggaagtgaataaacgtctggaatactcgctggtcaaaggcattaccgagtttatcgagcaggataccgaagaagcccgccagcaggctacgcgtccgattgaagtgattgaaggcccgttgatggacggcatgaacgtggtcggcgacctgtttggcgagggcaaaatgttcctgccgcaggtggtgaaatcggcgcgcgtcatgaaacaggcggtggcgtatctcgaaccgtttattgaagccagcaaagagcagggtaaaaccaacggcaagatggtgatcgccaccgtgaaaggcgatgtccacgacatcggtaaaaatatcgttggcgtggtgctgcaatgtaacaactacgaaattgtcgatctcggcgtgatggtgcctgcggaaaaaattctccgtaccgctaaagaagtgaatgctgatttgattggcctttcagggctgatcacgccgtcgctggacgagatggttaacgtggcgaaagagatggagcgtcagggcttcaccattccgctattgattggcggcgcgaccacctcaaaagcgcacacggcggtgaaaatcgagcagaactacagcggcccgacggtgtatgtgcagaacgcatcgcgcaccgttggtgtggtggcggcgttgctttccgacactcagcgcgatgatttcgttgctcgtacccgcaaggagtacgaaaccgtgcgtattcagcacggacgaaagaaaccacgcacaccaccggtcacgctggaagcggcgcgtgataacgacttcgcttttgactggcaggcttacacgccgccggtggcgcaccgtctcggtgtgcaggaagtcgaagccagcatcgaaacgctgcgtaattacatcgactggacgccgttctttatgacctggtcgctggccgggaagtatccgcgcattctggaagatgaagtggtaggtgttgaggcgcagcggctgtttaaagacgccaacgacatgctggataaattaagcgccgaaaaaatgctgaacccgcgtggcgtggtgggcctgttcccggcaaaccgtgtgggtgatgacattgaaatctaccgtgacgaaacgcgtacccatgtgattaatgtcagccaccatctacgccaacagaccgaaaaaaccggcttcgctaactactgtctcgctgacttcgttgcgccgaagctttctggtaaagcagattacatcggcgcatttgccgtgactggcgggctggaagaggacgcactggctgatgcctttgaagcacagcatgatgattacaacaaaatcatggtgaaagcgcttgccgaccgtctggcggaagcctttgctgagtatctccatgagcgtgtgcgtaaagtctactggggctatgcgccgaacgagaacctcagcaacgaagagctgatccgcgaaaactaccagggcatccgtccggcaccgggctaccctgcctgcccggaacatacggaaaaagccacaatctgggagctgctggaagtggaaaaacataccggtatgaaactcacggaatccttcgccatgtggccgggtgcatcggtttcgggttggtacttcagtcatccagacagcaagtattacgcggtggcgcaaattcagcgcgatcaggttgaagactatgcccgccgtaaaggaatgagcgttaccgaagtcgagcgttggttggcaccgaatctggggtatgatgccgagtaagtgataacaccggggtatttgccccggtttttaatgtcataaataatggattattgaacatgataaaaattgatgaaatagattttttcgctttcgaaggatgttcagagtccgaagttactgaactattaggaaaaaaaccaacaggttataatgattggatgattaatataaaaacaggtgtggagtgggtattttatgatggtcgttattggttagattttcgtaaatccaaagagggtataaggtgtatctcatgcagtattctgtatcacgataaaagtaaagggcgtatcgatgtcttatttagtgaaggtatagctgacagaggtttaaaaaatacgggtggagtgttaatccaaaaacgcccgcaattataataattcctggtaatatttgttttcgtaaaaaggatttactttatgcaacgtcaatataaaaaatacattcttcttttttggggtgtcatggatgttatcgcgatagccacatatctgttctactcgcttggtaatggtcgtatccctttttattccgatatcgttcattcactttctttacttaaggatatcggtgttgaaggcggtttttacgcttatgcagtcgccactgttacgctacaaatagtattattgctctctttattcttttctgcgcaatgttttttaagacaaaaattatttagtttctcttttttggcgattcaggagtttatgcgttttgctaccgtaagctgttcaatctccgtaataccgttgttacttaattatttttattcacaggatctggtcttaaatatttcgttgtttatcttctcagaggtcacaaaagtgacaacgattatctggtgtaaacgacaggggaaagtgtgacagaaatagcaacagatacaggtggatttttatataaatgcctttttaaatgctttcttgtataaatctcttatactgaaagtacatacaagagaaatgcctggataaaaacaacgtgattagaaaaatcttaacaggaaaatgcataacaaaaaggagaacctgattccgtgctaactttgcttcacctgctttctgccgtcgccctgctggtctgggggactcatattgttcgaacaggcgtaatgcgcgtcttcggcgcgcgtctgcgtactgtccttagccggagcgtcgaaaaaaagccgctcgccttttgcgcggggatcggcgttaccgcactggtgcagagcagtaatgccaccaccatgctggtgacctcgttcgtcgctcaggatctggttgctctcgcgcctgcgctggtgattgtgctgggtgcagatgtcgggacggcgctgatggcgcgtattctcaccttcgatttatcctggctgtcaccgttacttatttttatcggcgtgatttttttcctcggacgcaaacagtcacgcgccgggcaactgggccgcgtcggtattggtcttgggctgattttactggcgctggagttgattgtgcaggccgtaacgccgatcactcaggcaaacggcgttcaggtgatctttgcctcgctgactggcgacattttgctggatgcgctgattggtgcgatgttcgccattatcagctactccagccttgccgcggtactgctgaccgcgactctgaccgccgcaggcattatctctttcccagtggcgctttgtctggtgattggtgcaaacctcggttccggcctgctggcgatgctcaacaacagtgccgccaatgccgcagcccgccgtgtcgcgctgggtagcctgctgtttaagctggtgggtagcctgattatcctgccgtttgttcatttgctggcagagacaatggggaagttgccattgccaaaagcggaattggtgatctatttccacgtcttctacaaccttgtacgctgcctggtcatgttgccattcgttgacccgatggcacggttttgcaaaacgattattcgcgatgaaccggaactggatacccagctacggcctaaacatctggatgtcagcgcgctggatacgcccacgcttgctctggcgaacgctgcccgcgaaaccctgcgcattggcgacgccatggaacagatgatggaagggctgaataaagtgatgcacggcgagccacggcaggagaaagagctgcgtaagctggctgatgacatcaacgttctctataccgccattaagctgtatctggcgcggatgccaaaagaggaactggcagaagaagagtcgcgccgctgggcggagatcatcgaaatgtcgctcaaccttgaacaggcctccgatatcgtcgagcgcatggggagtgaaattgccgacaaatcgctggctgcaaggcgagcattttcgcttgatggcttgaaggaactggatgcgctctatgagcaattgctcagtaatttaaaactggcaatgtcggttttcttctctggcgatgttaccagcgcccgtcgtttgcgccgcagcaaacatcgttttcgcattcttaatcgccgctattcccacgcccacgtcgatcgcctgcatcagcaaaacgtgcagagtattgaaaccagttcgctacatttaggcttactgggagatatgcagcgtctgaactcgctgttttgttcggtggcttacagtgtgctggaacagccggatgaagatgaaggacgggacgagtattaataccgtgaccctgaaggcctgataagacgcgtaaagcgtcgcatcaggcactatgaacaagatgccggatcatgcatccggcaattcacttaaaaacggtgacccgcttccagcggcaccgcttcttcaccagccttaaacacataagtggtgttcgggccacccagcgtagcgtgacctttacttactgtgatccagttaccttccggcagaccaataatcgtcagttctggcgcgacgaccagcagttcgcgaatacgctgctcacgggtttcacctttatggccttccggcagcgcgttggtgaagtgcgggttgatttgtagcgggaacagatttagcgcatcgaaaccttgcggatcgacaatcggcatatcgttggtggtacgaatggttgggcaagcaaggttagcgcctgcgctccagccaatatacagcgcgccacgtttcaccacgtcagtaatgggtgccagcagcccgcgctcgcggcactgtttcagcaactggaaagtattaccgccgccgacaatcacaatttccgcattttcaatcgcggcaacgggatcgacaacgctatgaataccggtgacagaaacacccagcggagcgagaaccgcagccgttttcgctgtgtaatcatcccaggtctgcgttacgccagcgaaaggaataaataccgcagaacggcgcccctgcaactgttcagcaatcagcggcagcgcgtgttccagccaggctttacccggcagcgtcgagttactcaataaaagcagttccattacttctccggttagtaagaaaacacggaaggaatgctaccactgcgaatttaaccacttactgacatggctcacgatgtcacatattgcacaggcgctgagactgatgacaaacacaggattgcctgatgcgctacgcttacctggcctaccagataactgcaatatattgaattttcgagattatgtaggccgaataaggcttcattccgcatccggcataaacaatgtgcactttgccaccaatttgagcgccccttaaggcgctgatgtttttttatccttctcgtgcacattgtgccacttctgcaatcagccgcacatcaggtcgcgaagttgccgcggcgaccagccagcgacatgcagagttaagtagcgcgattaatcatgggaaattgcctctgcatgggcgagcaggtattgctccgcctcaccggaccagatcccctgatgacgcgccagaattgccgccagtgcttgatcctgaatctgcgtgagtgacgtcagcggcaggtatttcccggtatacaccagctttttgccgccgccgacggcaggcaattcaagcgtggtttcgcccgcggcattcagcccaagaatatgtgttaccacttttgcggcctgcacttttttctcttcaatcaatttgaccgctgcgcgcatgtcgtcggtattgccgcctgatgtgcccacgtagtgggtaaatgcataatgcacatcgtagaaattaattggcgcgctgaagtgcttatcctgcggtccggcgaagaaattcagacaaccatctgtcgccagcaaggaagaggcgagagtcaccagtccttcattaggcacaaagacgaaaatatcatcgaagccgtgaccgccactcagtgccattaacgtatcaaatgctgcatcggcggcattgagataatgaatcagtgtttgcggttctgatggatagtgcttgcgtgcataactcaatttgtcgttgtcggtatcggtaatgacgagcagcgaagggttaacgggtccatgtagcgcataatcaatcgccaacagtcccattggtccggtgccgccgaggatcagcgtgcgcccttgcgggcgaatccccatcgtgtggttataactaccttcctgaagatgatagttggcgttgaacgcgccaatcacgcaggaaagcggttcaaccagcgagccttcaaaataggtttcgccgtcgtatgccagcaggcaatcttgttccatgacctcgttgggaataaccacatgcgtcgcttcgccgcctacccacgggaaggagtagccggggcaatccgggcggtcggggagttgcaggttggcctgaatcacataacgctgacccggctggaatttgtgctgccactttttacccacggccagaatatcgccgcaaaattcgtggccgatgatgatgggattggtcgccacatcgtcgggtacttttttatggttttcacccagattggcctctttccaggaagagaggcacaggctgtcagtgaccaccgtcgcgaggatttcatcctcctgcatttcaggaaggtcaaaggtttccagacgcaggtcacgtttgccataaagacgcagagctgttgttttcataaaccacctcatgttgagcgatgaccccggcagtcgtgccggggcgaagaatcaggacaggaagcccagcgcattaccgataatccctaaaccaaacagggcgaaaatcagccataccgggttaatttttttgttgagcagacgaaccatcagcagcgtcagaccgagcgccagcaaaccagggcaaagttggtcgaggatgttctgcacggttatggtgacggtggcaccatcggcggcaggcgtttgtgaaaccaccaacggtacgttgattgacgtccatttggtcaccagcacgcccatcacaaacagcccgagaatcgacgcgccttcggtgagtttttgcagcaaattaccgcccatatcgctgacgatattcacccctttgcgaaagccgagctgtaggccataccacttcatcgccagacgcaccgcgttgaaaataaagaagaacagtagggggccgagaatgttgcccgaaagtgccagagatgcgccgagcgcggcggtaatcgggcgcagcgttccccagaccagtggatcgccaactcctgccaatggtcccatcagaccgactttgatgccgttaatggtaccgtcatcaatttccgcgccgttggctcgcgcctcttccatggcggcagtgacgccgatgaccgggccacatacggctggcgtggtattgaagaacaccaggtgtcgcctgagcgccgcaacctgatcctcttttaatgggtaaagtcgtttgatggcggggatcatgtcgtagcaaaaacccagcccgtgaatacgttcaaagttaaaggatgcctgttgcaggttggagcgcagaaacatgctcaccagatcgctgcgtgtaatttttctctgttccatgatggctccgttaatcatcaagttggtcaagggcggtgatagtggtggtctggggatgtggttcagctttacgccactgtggatttaactggatgtagagcagggccatgatcacgccgacgccaccgaacgccagcagactgagatcgaggtagccacctgcgaggaaaccgaggaaaaagaaaggcatcaaatatttcacgcccatcatgcgaagcaccatggcgtaaccgaccaccacgataaaaccgccagcaatctgcagtccacgggtcacaaattcgggaatggcgctcagcatattgctcaccatatcagcgctgacgaacagcgagacaatcagtgccggaatagcaacgcgcagtgcctgcacgccaagcgcggagacatgcagaatatcgagagtgcgaaaccgtgcttcttccgctgctttatccgccgcgtgctggaacactacggtgatggtacgggcaaacaccgtcagcacctggcctgccgcagccacaggcaacgcgatggcgattccggtggcgatgctttgctgaccaacgataaccagaatggcggagattatgctggcgagtgcagaatccggagattgcgccgcgccgacgttcatccagccgagagctatcaattccagcgtaccaccgagcataattccggtttttaaatcaccgagaattaaaccaatcaccgtacaggcaattaacggacgatgagtctgaaattcatccagcacgctgcccattccggcaatacaggaaaaaagaaatatagcaatgatttgtagggtacttatttccatgatttgtcaccttttaagtgtcgtcatccctgcctgttaaagcatatgtacacaggcgctattatttaatttgcgattaactgttcgtttattttgtcgataatattgattgagggatctgacgctacgacgcgtaaatccagtatgacgccaagattatttaactcatgaaatgcgttaatatcatcgtcatctaatgaaactgctttggttaactgtttcttaccaggacgccaggccataccgccaatattcagggtacctatttttaccccctggcgaaccattgctaaggcatcctgtgggcgagtgaaaagataaaaaacggtttcgtcctgatattgcgggttgtgataaaccgcgacggctttttcaatattgaccacgttaaccttcattcccggtggcgcagcctgacgcaataatgtccggcgaacttcatcgttataaacttcgtcattgcagataataatgcgttgggcgttagccactttagaccagacggtagtgacctggccgtggatcaggcggtcatcaatgcgggcgagcgtaatgttcatcagaaatcctcctctgctgttgctacctgtctccagacgacgcaggtttgctttgcgatttgcgtcaggtgttcacacagttcatcaacattcatgctgtcctggttatcaaccagttcgagcgccagcggcagagaaaggccgctgattacccgcagacgaggattgcgcatcgcaagcatcgctgccgcattccacgggctgccgcactgtaaatccacggcgattagccactcgtcatgattgtgaatgctcactaacttctccagctttgccacaatgtctccggcgttctcgccgggcacaaattcaactgcctcgaccctggcatcgccgtacaccatctgaaccgattccagcatggcgcaggctaatttgccgtgggcgcaaaaaatggcattgaccataaagcctccttagccgcgcgttttgccgcctgcaatgttagtggttactccggtgatatagctggcgcgttcagacagcagataacaaacaaaatcagccacttctgctaatcttccggcgcgcccaataggaatggcgtttttggtatagccttcacgcagctgctcgacggtgatattgcgcgtccacgccagcgcttcttcatattccggcgtgcgcagtcctgttttttccagaatccccggcgcgataccgaccacacggataccgtgcttgcccagctctttcgaccaggagcgcgtgaagctattgagcgcggctttggtcgcggcgtaacagctttggccttctgagccttccagcccactttctgaggaaacattcacaatcacgccatcatgttgtttgaccatctgtcgcgccaccgcctgcgacatcagaaaaacgcctttctggttgatattgaccattttttcgaatgcagcttcgttgagttcatactgcccggcaggcgctttctcatcgaccagcagacgcgggaaattgaccccggcgttgttaaccagaccgtcgatgcgaccaaaacgctggataatttctgctaccgtatgatttatctctttggcgctggaaatatcggtcggccagaactgataacctttatggctttcatattgaccatcgccaccgtgaatatcgaccatctgtacattcgcgccttgtgctaataattcctctacaatcgccagaccaataccggatgcgccaccggtgacaataatgattttatcctgcaaatttaaccacgtttgcataacagactcctgattttagatagtagggacccgccgtaatttttattacggtaaacatcgggaagatttttatttcagtaatagttcagctgtgctgctattcgttaccagacaattaatatattttccacgcagtgcaccaacaattccgctgtatttttcttcgctcatggcaatgccaatggaataccgtgcctgctttaatttattcatttcgatagagagtgttttttcgctcatattcgtttcaaccattgcgccgtgaatatcaaaaaagcgcgagcaaatatcgccagcaacctggcgggcattcaggtcgtcactctcttcaccaccataaaacgcatgccagttagcgccgtcgcgaatggccggtgagccaattcccaccagggcgacatccagattatcccagtaggcagagatggttttaaagtgctgagactgcatgatcccattacgaattaatgggttatccagcagcgccggaaaatccgcgagatgcgattcccctttcagcttcgctgccgcgctgtaggttaatgtgtttacgtgatagcggctttcgagtttaccggacgggccgccaataatcggcacgcaaattaactgccgcgattgccccgcctgcggcaagttttcaaccagtgcgctcaccgcgcggccccaggaaaaaccgacaatatcgccaggttccagcaagcgatccagcagttgcgcgccgtgtaaccccatcatcgccagttgaatatcttcatcctcatcatttcctgacaccaccacaacgtctttcaggccaaacttttgcttcacttgctgctccagccagagattttcgttgtagtcatagttgatggcgatggtgacaattccctgatcgcggcctcgtttaagcaagcggctgatggtagtgcgataaatacccagttcgcgcgcaatttgcgcctgcgtcatatcctgttcgtaatagagttgggcaatcttcacaatcaaacggatatcgtcactgttttccattgccgcctcctggttctgcacatttgtgcaaatacgctttctcaccgcttgatctgatataaccccatcatgatggcctttcaaagcgatttttcactctttgcatggggggaaatagcgctttctcttgcacatttgtttctctgcgtagtagtcatcagcacaggtgtgcagcgatgcgtaatttgttgattattcttattttgccaggcaaatttgcatcgtacttccggagacacttttgtgataaaaggcgtggcagatcacatttaatttcgacgttgccgcataaccctgtttttccccgctaagaggtacggtatattccgcgttttacaggagaatttatgctgcccgactcatcagtccgtttaaataaatacatcagcgaaagcggaatttgctcacgccgcgaagcggatcgctatatcgagcaaggcaatgtgttccttaatggcaagcgagccaccattggcgatcaggtgaaacccggcgacgttgtgaaagtaaatggtcagttgattgagcctcgggaatccgaagatttggtacttatcgccctgaacaagcccgtcggtattgtcagcaccaccgaagatggcgagcgcgataacattgtcgatttcgttaaccacagcaaacgcgtgttcccgattggccgcctggataaagattcccaggggctgattttcctcaccaatcacggcgatctggtgaataagatcctccgtgcgggtaacgatcatgagaaagagtatctggtgacggttgataaaccgattaccgatgaatttattcgtggtatgggggcgggagtaccgatcctcgggacggtaactaaaaagtgcaaagtcaaaaaagaagcaccgtttgtcttccgcattaccctggtgcaggggctgaaccgtcagattcgtcgcatgtgcgagcactttggttacgaagtgaaaaagctggaacgtacgcgcattatgaacgtcagcttaagcggcattccgctgggtgagtggcgcgatttaaccgacgatgagttaatcgatctctttaagctcattgaaaattcctcttccgaggcaaaacctaaagcgaaggccaaaccgaaaacggtaggcatcaaacgtccagtcgttaagatggaaaaaacggcggaaaaaggcggtcgcccggcgtccaacggtaagcgttttacctcgccggggcgcaaaaagaaggggcgttaatcagcgtctgccgcgcgtcgacgtatttgctgaccagctaaatgacgcctcaggatccggtttataagcctgctttttcttcaattggcgggcttttttcgcttcagcctcacgctcgaccattaatttatcgatgtactctttcttaatgctgttagtttcggagttggtcagtacgcgaccatgcgcaatccgcgcccgatccagcagtgttttaagttcacgctgctcgcgttcagtcatctctttttgggtaatacgggggagtgccataatggtgccctcagtgagccagagagttcagtgtacgggaattcgtttgcgagcagaactgataatattcattttgccttctcttaactatttatctctttcgataattagttagagatgcggataaaaaattaaaggcaattattctccgataaagacgctggttaacagggaatagactcgtttatttatgggcataatgacaagaaaaacaatacggcccgaaataatgtcttccgggccatactgtgtttactcaaacaaattaaaatgcagcttctgcactacctgctcggcatcttcgccgggcaccaggaagcacaggttatggctggatgcgccgtaacaaatcatgcgaatgttgaacggttccagtacgccgaatacctctttgccaacgccgcaggcttttgacaggtcattgccaatcaacgcgaccagcgccagaccctcttccacttccacccggcacagtgcagacagctccatcagcagagattgcgtcagcaacgtatcgccagtggaggttgaaccggtggtatcaagggttaatgccacactcacttctgacgtggtgattaagtctaccgaaatattatgccgcgcgaggatgccgaaaacttccgcgaggaaaccgcgagaatgcagcatattcaggctgtgcaaagtgagcagagtctgattgcgacgaagcgccagcgcgcggaacagcggcggattttcagttttattgcacaccagcgtaccacctgcgcgtgggtctttgctggagccgacaaagactgggatatcgctgcgtactgcgggtagcaacgttgccggatgcagtacttttgcaccaaaagttgccatctctgccgcttcggcaaacgcgatttcatcaatgcgttttgctgcggaaaccacgcgtggatcggtggtgtagatgcccgggacgtcggtccagatatcaacacgagatgcgtgtaaagcctccgccagcaaggctgccgtataatcgctgcctccacggccaagcgtcgttgtacgacctttattttcgctgccgataaatccctgggtgatcactaagccttcattgaggcgtgggagcagctgcagcgcggccagttccgccagcgcggctacatctggctctgcacgaccaaatcgatcgttggtacgcatcactttacgtacatcaaaccactgtgcctgaacatcgcgttcgcgcaggatctcgacaaacagcagggtcgacatcagctcgccgtggctgaccagttcatctgtcagggccggagacgttgccagcgccgccgcttctgccagaacagtaatattctccagcagacgttcaatctcttcacggataacgttcgggtaacgcagacgttccagaatggcaaactggatattgcggattgcgtcgagtttttcgaatcgctcgccaggttccagtccttcagctaaagcgaccagtagattagtgataccagcagaagccgagaggacaactaaacgtacgttggcatcagaaagcacaatatcagcgctgcggttcatggcgtcaaaatcagctacgctggtaccgccaaatttggagacaacaatttcagacataactacctcgtgtcaggggatccattttcagccttggcacaagggaagagcggaagacgggtgggcgcagagcgatacttcgctactattttcacccagaagtgctccaccacttgcgaaacgcccgactgcgaacgcttctggtgacaacccaggggattcagcccctgtagccgatgatgaacgtagccagccgttcaatcacctcggcgatgcaccccctcaggtgttatcacaggactggctcctccaacaccgttacttgggcaacgcgcctcttctggcctgcgctagcgcaggtagtacatttataaataaagggtgagcggggcggttgtcaacgatggggtcatgcggatttttcatccactcctggcggtcagtagttcagctaataaatgcttcgctgcgctaagggtttacactcaacattacgctaacggcactaaaaccatcacatttttctgtgactggcgctacaatcttccaaagtcacaattctcaaaatcagaagagtattgctaatgaaaaacatcaatccaacgcagaccgctgcctggcaggcactacagaaacacttcgatgaaatgaaagacgttacgatcgccgatctttttgctaaagacggcgatcgtttttctaagttctccgcaaccttcgacgatcagatgctggtggattactccaaaaaccgcatcactgaagagacgctggcgaaattacaagatctggcgaaagagtgcgatctggcgggcgcgattaagtcgatgttctctggcgagaagatcaaccgcactgaaaaccgcgccgtactgcacgtagcgctgcgtaaccgtagcaataccccgattctggttgatggcaaagatgttatgccggaagtcaacgcagtgctggagaagatgaaaaccttctcggaagcgattatttccggtgagtggaaaggctataccggcaaggcaatcactgacgtagtgaacatcgggatcggcggttctgacctcggcccgtacatggtgactgaagcactgcgtccatacaaaaaccacctgaacatgcactttgtttctaacgtcgatgggactcacatcgcggaagtgctgaaaaaagtaaacccggaaaccacgctgttcctggtagcatctaaaaccttcaccactcaggaaaccatgaccaacgcccatagcgcgcgtgactggttcctgaaagcggcaggtgatgagaaacacgttgcgaaacacttcgctgcgctctcaaccaacgccaaagccgttggcgagtttggtattgatactgccaacatgttcgaattctgggactgggtcggcggtcgttactctttgtggtcagcgattggcctgtcgattgttctctccatcggctttgataacttcgttgaactgctttctggcgcacacgcgatggacaagcatttctccaccacgcctgccgagaaaaacctgcctgtactgctggcgctgattggcatctggtacaacaatttctttggcgcggaaactgaagcgattctgccgtatgaccagtatatgcaccgtttcgcggcgtacttccagcagggcaatatggaatccaacggtaagtatgttgaccgtaacggtaaggttgtggattaccagactggcccgattatctggggtgaacctggcacgaacggtcagcacgcgttctatcagctgatccaccagggaaccaaaatggtaccgtgcgatttcatcgctccggctatcacccataacccgctctctgatcatcaccagaaactgctgtctaacttctttgctcagaccgaagcgctggcgtttggtaaatcccgcgaagtggttgagcaggaatatcgcgatcagggtaaagatccggcaacgcttgactacgtggtgccgttcaaagtgttcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggagctgggtaaacaactggcgaaccgtattctgccagagctgaaagatgataaagaaatcagcagccacgatagctcgaccaatggtctgattaaccgctataaagcgtggcgcggttaatcattgtcgatatgtaggccggataaggcgttcacgccgcatccggcaaccgatgcctgatgcgacgcggtcgcgtcttatcaggcctacaggtcgatgccgatatgtacatcgtattcggcaattaatacatagtacgattgattaaatagccttaaaaacaatgccgactataagtcggcattgttttatcagataaatcctcttgtctgtcatttaacgaaaatcataccgtgaggttaatcctaaaataaatttttaatcgtggtttatttcggaaaatacgcagagtaattactttttattttattttaacttcatgatttttaatcttatttatatataagtcaaagcttatatttgatattcattccaattgtcctaaaactccatcactaattccccgcgccgtaattcgcatgctttagttgtgtatactcgatcccgcccgaaatgttttgggtaaatctccattcattcaatgaagggaaattgttatgaaaaaagttctgtatggcatttttgccatatctgcgcttgcggcgacttctgcgtgggctgcacctgtacaggtgggcgaagcggcaggatcggcagcaacgtcggtttcggcggggagttcctccgcgaccagcgtcagcaccgtaagctcggcggtgggtgtcgcgctcgcggcaaccggtggcggtgatggttctaataccgggaccaccacaaccacgaccaccagtacccagtaataaagtatgtatccccaaaataattcgagtcatcgcatctgaagcttgaagtatgaaggggattaaccataaccacactccggtgtggttattctgcccctctggagaagagtcgtgaagcgacctgcactcattcttatctgcctgctattacaggcctgttcagccacgactaaagagctgggcaattcactgtgggacagtctgttcggcacgccaggcgtacagctgacggacgatgatattcaaaatatgccctacgccagccagtacatgcagcttaatggcgggccgcagttatttgtggtgctggccttcgctgaagacggacaacaaaaatgggtcactcaggatcaggccactctcgtcacacaacatggtcgtctggtgaagactttgcttggtggcgacaacctgattgaagtgaataaccttgccactgacccgctgattaaacccgcacaaattgttgatggtgcaacatggacgcgcacgatgggctggaccgagtaccagcaggtacgctacgccaccgcacgctcagtcttcaaatgggatggcaccgataccgtcaaagtcggcagcgatgaaaccccggttcgcgtgctggacgaagaagtctccaccgaccaggcgcgctggcataaccgctattggatcgacagcgaagggcaaattcgccagtcggaacagtatctcggcgcggattatttcccggtgaaaaccactctcatcaaggcggcaaaacaatgattaaacaaactattgtcgcattgattttgagtgtgggggcgtcatcggtcttcgcggcgggaaccgtcaaggtattcagcaatggcagcagtgaggccaaaacgctgacgggtgcagagcatttaatcgatctggtaggccaaccacggctggcaaacagttggtggcccggagcggtgattagcgaagagctggccacggcggcagcattgcgtcagcagcaggcgttgctgacacggctggcagaactggctgcagattccagcgccgacgatgccgccgcgattaacgccttacgccagcaaattcaggcgttgaaggtgacgggcaggcaaaaaatcaatcttgatcctgatatcgtccgcgttgccgaacgcggtaacccgccgttgcagggcaactacacgctgtgggtcggaacgccgccgtccacggtcacgttgttcgggcttatcagtcgtcctggcaagcagtcattcactccaggtcgcgacgtggcgagctatctctctgaccagagcctgctcagcggtgcggatcgcagctacgcgtgggtggtttacccgtccggacgcacgcaaaaagcgccggtggcttattggaacaagcgtcacgtagagccgatgcccggcagcattatttatgttggcctcgcggactccgtctggagtgagacacctgatgcccttaacgccgacattcttcagactctgacgcagcggataccccaataatgaaaaaaagacatctgcttagcttactggcgctgggcattagcacagcttgctacggcgaaatatatcctgcgcccattggtccgtcgcaatcggatttcggtggcgtaggattattacaaacgcccaccgcgcgcatggcgcgggaaggggagctgagcctgaactatcgcgataacgatcagtaccgttattactcagcttcagtgcaactcttcccgtggctggaaacaacgctgcgctacaccgacgtgcgcacccggcagtacagcagcgtcgaagcattctctggcgatcaaacgtataaagataaagccttcgatctcaaactgcgtttgtgggaagagagttactggctgccgcaagtggcggttggtgcgcgggatattggcggtacggggctgtttgatgcggaatatcttgttgccagcaaagcctgggggccgttcgattttacgctcggtctgggctggggatatctgggcaccagcggtaatgtgaaaaatccgctctgttcagccagtgataaatattgctatcgcgataacagctacaaacaggcgggatctatcgacggtagccagatgttccacggcccggcctcactgtttggcggcgtggaataccagacgccctggcaaccgctgcgcctgaaactggagtatgaaggcaataattatcagcaggattttgccgggaagctggagcaaaaaagtaagtttaacgtcggggcgatttatcgcgttaccgattgggccgacgttaaccttagctatgaacgtggcaacacctttatgtttggcgttacgctgcgcaccaactttaacgatctgcgcccgtcctacaacgataacgcccgcccgcaatatcaaccgcagccgcaggatgccattttgcagcactcggtggtggcgaatcagttaacgctgttgaaatacaacgccggactggccgatccgcagatccaggcgaaaggcgatacgctgtatgttaccggcgagcaggtgaaatatcgtgattcgcgcgaagggatcatccgtgctaatcggatcgtgatgaacgatctgccggatgggatcaaaacgatccgcattacggaaaatcgccttaacatgccgcaggtgacgacggaaaccgatgtcgccagcctgaaaaatcatctcggcggagagccgttgggccacgaaacgacgctggcgcaaaaacgcgtcgagccagtggttccgaagtccaccgagcagggctggtatatcgacaaatcacgctttgatttccatatcgatccggtgctgaaccagtcggtcggtggcccggaaaacttttacatgtatcagctgggcgtgatgggaacggcggatttgtggctgacggaccatctgctgaccaccggcagcctgtttgctaaccttgccaacaactacgacaagtttaactacaccaatccgccgcaggactcgcacttaccgcgcgttcgtacccatgtgcgcgagtatgtgcagaacgatgtctatgtgaataacctgcaagccaactacttccagcatctgggcaacggcttctacggtcaggtctacggaggttatctcgaaaccatgtttggcggtgcgggggcagaagtgttgtatcgcccgctggacagcaactgggcgtttggtctggatgccaactacgttaaacagcgcgactggcgtagcgcaaaagatatgatgaaattcaccgattacagcgtgaaaaccggacatctgaccgcgtactggacgccatctttcgcccaggacgtgttagtgaaagcgagcgtcgggcagtatctggctggggataaaggcggcacgctggagatcgccaaacgctttgatagcggcgtggtagtggggggctatgccacgatcacgaatgtttcgaaagaggagtacggcgaaggggacttcaccaaaggcgtgtatgtctctgtaccgctggatctcttctcgtctggcccgacacgcagccgtgcggcgattggctggacgccgctgacgcgtgacggtggtcagcaacttgggcgtaagttccagttgtatgatatgaccagcgaccgtagcgtcaatttccgctaagtcatgggaaaggtgccagttttcgcactcactggcaccttcattcttaatggcctgtcgagccatcaggaacgcagttcacccccggtttgcgatctggtgtgtaaaggcgaaaacattctgtcttcctgtccgtcgatatcggttgcaggtctggttgcctgagcgactgggccatcattggactggagacattgctttgcggtaggtcggctttatcagcagtaccgagcggaccagcataagcaggaagaacagagactgataacatcaaagcagcaaaataagacttcatttttaccacctttatcaggttacgtttcatttgttccagaggaacattgtcgatttttcgcgcattgctggtggctgggaatcacctgaatgggtgatttttttgggctgtgtgttttgccagatgcgacgttgatgggagatgcccacttaattgagctgaacaaaacatacacaaaaaatatagatctccgtcacatttttgcgttatacaggaagctcgccactgtgaaggaggtactgctatgacgtcactctctcgtccgcgcgtggagtttatctccaccattttgcagaccgtactcaatcttggcctgttgtgcctcggcctgattttggttgtcttcctcggcaaagaaacggtgcatctggctgatgtgctgtttgcgccagaacaagccagtaaatatgagctggtagaagggctggtggtttactttctctatttcgaatttatcgcgctgattgtgaagtactttcagtccggttttcacttcccgctacgttactttgtctatattgggatcaccgccattgtgcgcttgatcatcgtcgatcataaatcgccactggatgtgttgatctactcggcagcgatcctgttactggtgatcaccctgtggctgtgtaattcgaaacggctgaagcgggagtaaaaaaaggcgctccgtggagcgccgaataacagtcacaagttgggataacgtaagttgagggtgcagcggcataacattggcagaacaacatctttaacctttcacaccacctgccgtcaggccgttgaccagccagcgttgagccagcaagaagacgatggtgatcggtaatgcagacatcacggcagcggcggcaaagtcaccccacaggtagttttgcgggttgaggtattgctgcatccccacggccagggtgtagctgtttacgtcacgcagtaatagcgacgcgaccggaacttcagtaatggcagcgataaacgacaggatgaacacaaccgccagaatcggtactgacagcggcaacaggacaaggcggaaggcctgccacggtgtcgcaccatccagcgccgccgcttcttccagcgaactgtcgatggtttcgaaataacctttgatggtccagacatgcagcgcaatcccgcccagatacgcgaaaattacgccgccgtgagtattcaggccaatgaatggaatgtactcacccagacgatcaaacaacgcatacaacgcgaccagtgaaagtactgccgggaacatctggaaaatcagcattcctttcagcagcgtcgctttgcctggaaagcgcatacgggcgaaagcgtaggcgcaggtggtggagagcgccacaatgccaatcgcggaaatcccggcgacctttaccgagttccacagccacagcagtaccgggaatggcggtggcgtaatgcgaccatcagcctgttccacgctaaaacctaacgccagtttccagtgatcccaggagatttgctccgggatcagactaccggtcgcgaagttcccctgacgcagcgagatggcgacgaccatcagcagcgggaacataattgccgcgataaaaagtagcagtagcaggtgagtaataaacaaacgtgctttttgcgatttcggttggaccattgccatttttgttatctcccttaatcaaacttcattcgcgtggctttcaggttcactatcgccagcgcgcccaccagcaggaagatcagcgtggcaattgctgctgccagaccgaagtcctgacccccgccgccttcaaaagcgatacggtaggtgtagttaacaagcaggtcggtataaccggctggcgtggtcgtgccaagacgatccgggccgccgttggttaacagttgaatcagcacgaagttgttaaagttaaaggcgaagctggcgatcatcagcggcgtcagcggtttaatcagcagcggcagcgtaatcttaaagaagttctggaatggacctgcgccatccattgctgaggcttcatacaaatcgtccggaatcgccttcagcaagcccatgcagaggatcatcatgtacggataacccagccaggtgttgacgataatcagcatcgtgcgggcggtggtcggatcgctgaaccaggcgggcttcacgccaaacagcgcgctcaacatcatgttgatttcaccaaaactctggttaaacaaccctttgaaaatcaagattgaaatgaacgatggcaccgcgtagggcagaataagcaggacgcgatagaccgctttgccgcgcaacgcttcccactgcaccagacacgccagaaccatgccgaccgccaccgttaaaaagacagtgatcagcgagaacaccacggtccagacgaaaatggcgaggaacggtttctgaatgccttcgtcggtaaagacgcgggtaaagtttttccagccggtggtcacggtgtaaccggggcttagcttttcatccccccagtgaccgtcggcggtaatggattggtaaaaaccaatttggttattcggccgatatttcacgccgctctggttattcgtcaacgtgccgtcaccgtcgagtgtgtagagcggctgcgtgccagaaaactggcgcagggagctcatcatcactttgttgccatccggcagaatggcggtaatgtcactcagtgcctgacgattctgggtaattacgcgcagattcgcgcgttcgccttcgggctgggcggtcgtttctttcagttgcagtttttgctcgccgccaaatttaaaagcgtcggagaggtaatttttgccggtttcgccgtcgctgagcgccagttgccactcatcgcccgccggataaagaccaaaattatagattttgcctgcttgccaggagcgatctagcaacacttcctgcgcacgttcaaaagtcagctggttagtgctgctgtagttggtgaaggcaatggcgatggtgcagaccagagggaagaggacgaataatcccattccagccattcccgggtaaacatagcgccaggcgtaggctttacgattggcgaaaatatacagccccgctgagctcaatatcagcgtggtaatggcgaacaggtattccccttgtgcgtacattaaaacaacaaggtaacccaccagcaggccgagcagacctaacactgaccatttcagcgcgtcgctttgccaccaatgtttctttttaatgacatccatggggttcttcctcattccaggacggataaggctttcataccttatccgacaacaactgcctgatgcgacgctgacgcgtcttatcaggcctacatacgtttcaatttcgtaggccggataaggcgtttacgccgcatccggcatttcacagcattacttggtgatacgagtctgtgcatctttcagcgcagcatccacagtctgacgaccgctggcggcgttgatcaccgcagtacgcacggcataccagaaagcggacatctgcgggatgttcggcataatttcacctttctgagcgttatccatggtggcggcaatacgtggatctttcgcaagttcatcctgataggacttcagcgctactgcacccagcggtttgtctttattgaccgcttccagaccttcgtcagtcagcagatagttttcgaggaactctttcgccagctctttgttcggactggcggcgttaatacctgcgctcagcacgccaacgaacggtttagatggttgacctttgaaggtcggcagtaccgttacaccataattcactttactggtgtcgatgttggaccatgcccacgggccgttgatagtcatcgctgtttcgcctttattaaaggcagcttctgcgatggagtaatcggtgtctgcattcatgtgtttgtttttaatcagatcaaccaggaaggtcagacccgctttcgcgccagcgttatccacgcctacgtctttaatgtcgtacttgccgttttcatacttgaacgcataacccccgtcagccgcaattagcggccaggtgaagtatggttcttgcaggttgaacatcagcgcgctcttacctttcgctttcagttctttatccagcgccgggatctcttcccaggtttttggcgggttcggtagcagatctttgttataaatcagtgataacgcttcgacagcgatcgggtaagcaatcagcttgccgttgtaacgtacggcatcccaggtaaacggatacagcttgtcctggaacgctttgtccggggtgatttctgccaacaggccagattgagcgtagccgccaaagcggtcgtgcgcccagaagataatgtcagggccatcgccagttgccgcaacctgagggaatttctcttccagtttatccggatgctcaacggtgactttaattccggtatctttctcgaatttcttaccgacttcagcgagaccgttatagcctttatcgccgttaatccagattaccagtttaccttcttcgattttggcgagagccgaggcggaaaacatcatcgtcgttaatgcggataatgcgaggatgcgtgcacctgtttttattttcataatctatggtccttgttggtgaagtgctcgtgaaaacacctaaacggactctagtttctttatacggcaacctctttccatcctccttgcccctacgccccatcgttgctttgtgtgatctctgttacagaattggcggtaatgtggagatgcgcacataaaatcgccatgatttttgcaagcaacatcacgaaattccttacatgacctcggtttagttcacagaagccgcgttctcatcctcccgcctcctcccccataaaaaagccagggggtggaggatttaagccatctcctgatgacgcatagtcagcccatcatgaatgttgctgtcgatgacaggttgttacaaagggagaagggcatggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaagcggatgaatgacactccgcctgcagaacgcggcgttggtatggtgtttcagtcttacgcgctctatccccacctgtcagtagcagaaaacatgtcatttggcctgaaactggcgggcgcgaaaaaagaagtgattaaccagcgagttaaccaggttgcggaagtgctgcaactggcgcatttgctggatcgcaaaccgaaagcgctctccggtggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgctggtcgcgtggcgcaggttgggaaaccgctggagctgtatcactatccggcagaccgttttgtcgccggatttatcggttcgccaaagatgaacttcctgccagtaaaagtgaccgccaccgcaatcgatcaagtgcaggtggagctgccgatgccgaatcgtcagcaagtctggctaccggtcgaaagccgtgatgtccaggttggagccaatatgtcactgggtattcgcccggagcatctactgccgagtgatatcgctgacgtcatccttgagggtgaagttcaggtcgttgagcaactcggcaacgaaacgcaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaagcaccccacaaaacacacaaagcctgtcacaggtgatgtgaaaaaagaaaagcaatgactcaggagatagaatgatgattactctgcgcaaacttcctctggcggttgccgtcgcagcgggcgtaatgtctgctcaggcaatggctgttgatttccacggctatgcacgttccggtattggctggacaggtagcggcggcgaacaacagtgtttccagactaccggtgctcaaagtaaataccgtcttggcaacgaatgtgaaacttatgctgaattaaaattgggtcaggaagtgtggaaagagggcgataagagcttctatttcgacactaacgtggcctattccgtcgcgcaacagaatgactgggaagctaccgatccggccttccgtgaagcaaacgtgcagggtaaaaacctgatcgaatggctgccaggctccaccatctgggcaggtaagcgcttctaccaacgtcatgacgttcatatgatcgacttctactactgggatatttctggtcctggtgccggtctggaaaacatcgatgttggcttcggtaaactctctctggcagcaacccgctcctctgaagcgggtggttcttcctctttcgccagcaacaatatttatgactataccaacgaaaccgcgaacgacgttttcgatgtgcgtttagcgcagatggaaatcaacccgggcggcacattagaactgggtgtcgactacggtcgtgccaacctgcgtgataactatcgtctggttgatggcgcatcgaaagacggctggttattcactgctgaacatactcagagtgtcctgaagggctttaacaagtttgttgttcagtacgctactgactcgatgacctcgcagggtaaaggtctgtcgcagggttctggcgtcgcgtttgataacgaaaaatttgcctacaatatcaataacaacggtcacatgctgcgtatcctcgaccacggtgcgatctccatgggcgacaactgggacatgatgtacgtgggtatgtaccaggatatcaactgggataacgacaacggcaccaagtggtggaccgtcggtattcgcccgatgtacaagtggacgccaatcatgagcaccgtgatggaaatcggctacgacaacgtcgaatcccagcgcaccggcgacaagaacaatcagtacaaaattacccttgcacaacaatggcaggctggcgacagcatctggtcacgcccggctattcgtgtcttcgcaacctacgccaagtgggatgagaaatggggttatgactacaccggtagctcttcaaccaacccatactacggcaaggctgtgtcggctgatttcaacggcggtagcttcggtcgtggcgacagcgacgagtggaccttcggtgcccagatggaaatctggtggtaatagcaaaacctgggccggataaggtgcttgcgccgcatccggcaaccaatgcctgatgcgacgctgttgcgtcttatcaggcctacaaccgctgccgaaagtaggccggataaggtgcttgcgccgcatccggcaaccaatgcctgatgcgacgctgttgcgtcttatcaggcctacaactgctgccgaaagtaggccggataaggcgtttacgccgcatccggcataaaaacagctttaaggggcgaaagcccctctgattatcgggtttagcgcgctattgcctggctaccgctgagctccagattttgaggtgaaaacaatgaaaatgaataaaagtctcatcgctctctgtttatcagcagggttgctggcaagcgcacctggaatcagtcttgccgatgttaactacgtaccgcaaaacaccagcgacgcgccagccattccatctgccgcgctgcaacaactcacctggacaccggtcgatcaatctaaaacccagactactcaactgtcgaccggcggccaacaactgaatgtccctggcatcagtggtccggttgctgcgtacagcgtcccggcaaacattggtgaactgacactgacgctgaccagcgaagtgaacaaacaaaccagcgtatttgcgccgaatgtgctgattcttgatcagaacatgactccatcagccttcttccccagcagttatttcacctaccaggaacccggcgtgatgagtgcagatcggctggaaggcgttatgcgcctgacaccggcgttggggcagcaaaaactttatgttctggtctttaccacggaaaaagatctccagcagacgactcaactgctcgacccggctaaagcctatgccaaaggcgtcggtaactcgatcccggatattcccgatccggttgctcgtcataccaccgatggcttactgaaactgaaagtgaaaacgaactccagctccagcgtgttggtaggaccactatttggttcttccgctccagctccggttacggtaggcaacacggcggcaccagctgtggctgcacccgctccggcaccggtgaagaaaagcgagccgatgctcaacgacacggaaagttattttaataccgcgatcaaaaacgctgtcgcgaaaggtgatgttgataaggcgttaaaactgcttgatgaagctgaacgcctggggtcgacatctgcccgttccacctttatcagcagtgtaaaaggcaaggggtaattacgccccacagtgctgattttgcaacaactggtgcgtctcctggcgcacctttttttctcctcctgtactattgttgcgtttttgttgcgcattagttcacttaatttgctttacatctcccgtaaatatttttctgcgatacaatgcctttacgttatgtaacggagagttcggcatgtcacaccccgcgttaacgcaactgcgtgcgctgcgctattttacagagatccctgccctggagccgcaactgctcgactggctgttgctggaagattccatgacaaaacgttttgaacagcagggaaaaacggtgagcgtgacgatgatccgcgaagggtttgtcgagcagaatgaaatccccgaagaactgccactgctgccgaaagagtctcgttactggttacgtgaaattttgttatgtgccgatggtgaaccgtggcttgccggtcgtaccgtcgttcctgtgtcaacgttaagcgggccggagctggcgttacaaaaattaggtaaaacgccgttaggacgctatctgttcacatcatcgacattaacccgggactttattgagataggccgtgatgccggactgtgggggcgacgttcccgcctgcgattaagcggtaaaccgctgttgctaacagaactgtttttaccggcgtcaccgttgtactaagaggaaaaaaatatggagtggagtctgacgcagaataagctgctggcgtttcatcgcttaatgcgtacggataagccaattggcgcgttactgctgctctggccaacattatgggcgttgtgggtggcgacaccgggcgttccccagctctggatcctggcggtgtttgtcgcgggcgtctggctgatgcgcgctgctggttgtgtggtgaatgattatgctgaccgcaagtttgatggtcatgttaagcgcacggcgaaccgaccacttcccagcggcgcggtaacggagaaagaggcgcgcgcgctgtttgtagtgctggtactgatttcatttttactggtgctgacgctgaatacgatgactattctgttgtcgattgccgcgctggcgctggcgtgggtatacccgtttatgaagcggtatacccatctaccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccaccgcaatcctgttcggccaatacgataaattgattattggtatttttcagattggcgtactagcgctgatggcgatcatcggtgagttaaatggcttaggctggggatattactggtcaattctggtagctggcgcgctgtttgtttatcaacaaaaactgattgccaaccgcgagcgtgaagcctgctttaaagcatttatgaataataactatgttggtctggtactgtttttagggctggcaatgagttactggcatttctgatgatgtaaaaaagccggatgatcatccggctttcttctgggttgcctgatgcgctgcgcttctcaggcctacaacatatcgcaatttattgaatttgcagatcatggtaggccgaataaggcgtttgcgtcgcatccggcaattctcactgattacccttcgccctgcgtcgcactctcaatcgtcaaacgcacgtctgatgtaatcaactccgccagcaactgatacaccttcatcgtttctgccggttcggcgtcgccgctatcgctgatatacccttcatcacgcagtgtcagcaccagagaactgaacaccgccttgtcgaagaactccggcgcgttgataccgtgcagcacggagagacgttgcgcgacggtgcggctctctttttccagcgtaccgcggttgatcgacgggttggcactcaacagccagaaggtgatggcataacgttgcagcgtttcgcgcgcgcctgcggccagcagctgtagcgtgcgagaatgcgccgggttgatatgcaactcatcatcttgcagggtaatcagcccctgacgttgcatctcatttgccagcgcatcaataacgtccggtaactcgtcgcgatcccagcgcaggaacagctccgctttcagcattgggtaaagcacattgacgtgctccatcaatacgtcgcgggagatgtggcgatgctgggtgacaattgccgccatcagcgaaggcagcaccaacatatgtgcaatgttgttgcgatagtaggtcatcagcaccgcttgctcgcgcggcagaatgatgatgtcgccgatagtgtctttctcaacttcaaacttgttcatttgcagcgcgtgatcgataagctcgctggcgctggctgaaggaacggtagagtccgtggagtaaggcacgttgcgcatcagatccaggtagcagttgagttgctcggttaactgctcgcgggtgagtgagcgctgacgtgacgccagaagcgcagtacagcacaggttcatggcgtttgccgcgcctgcgttgttaatgcgtaccatcagatcggcagcaatattattgaccgtcggcgttaaccaggccggacgcaccgcttcgatgggatcgatagattcacgccagtctggtacgtgctggttaaggtaggtcatcaacggcattggttcaccgaagttgacgtaaccctgaccgagattacgcagcttgcttaaaccacgcagcatctgcggcaggctctctttctctttcgtcgcaccgcgcagttctttggcgtaagtacccacttccatgacgtgctcataaccgatatagatcggaatcagcgtaatcggacgagtgccgccacgcagcatcgcctgaatggtcatcgatagcgtaccggttttcggatccagcaaacgccccgtacgggaacgaccgccttccacgaaatactcgacggaataaccacggctgaacagttcgccgagatactcacggaaaacggtggaataaagtttattgcctttaaacgtacggcgaataaagaacgcccccagacggcggaaaatcggcccggccggccagaagttcaggttgatcccggcggcgatatgcggcggcaccagcccctggtgatacagcacgtaagaaagcagcaggtagtccatgtgactgcggtggcaaggcacatacactagctcatggccgtcgtgggccagctggcgaacgcgctcggcgttatggacgttgataccctggtaaagtcggttccaggtgaagcccagaatgcggtcagtcaggcggatcatctcgtaagagaaattcgccgcaatctcttccatcagcgcaatcgcgttctgctgcgctttttcatgggagatttttttgctgcgcgcttcatcttctaccgctttcgcaatggcgcgggaggcgagcagcttattaaacagatcctgacgagcaggcagacgtggacccacggcagccaggcgttgacgggcaaagtgcatacgcgccacgcgcgccagtttctgagcgatagttttatccgtgccgtgttcatccgccatacggcgcagcgaaactgacggcgagaaacgcacaaaactgtcgcgaccgagccacagtacagcgaaaaatttctgtacaccgttaagcatacgcagcggcgggttcacttcgcctttttcacgccccggcgcgcgaccaaacatcaccgatactggcaccatctgcacatccagatttgggttgctgcggtgcaaatcgagatagtcgtggaacagcttaatagactcttctttcggcgtgtaataggtgaacacacgcggcccgccgtgaatgaacacatagcgcggcagtagcgtgccgtcgatttccagcggctctaacgggtcaggcaggtcatgtgccagacactgggcgcgcaacgtcagcaagtcagctttcgagttgtacggtaaaacgtacataattggacgagaggtatccagccccagttccggggcaggatccgccggaatagacttgctttttaccaggatgcttaatggtaaattcagtaatttgtagtaaattcgtggccagccggacataaacgatgtaaagcctctggttaataatgcaaatgcgcggcaaggatagcagaaagtcatgggaaattctgtggtatccgctcatgtttcgcgcggcgttacgcaaacccgaatcatcggatttaacggtacactgatattgacgctcataatgtaaaaaggttctttcaatggccaataataccactggattcatccgaattattaaagctgctggctattcctggaaaggtttacgcgctgcatggatcaacgaagcggcattccgtcaggaaggcgtagcggtattgttagcggtggttatcgcctgctggctggatgtggacgcgattacccgcgtgctgcttatcagctccgtgatgctggtgatgattgtggaaattctcaatagcgccatcgaagctgtggttgaccgaattggctctgaataccatgagctttccggacgcgctaaagatatgggatccgccgcagtgctgattgccattatcgtcgccgtgattacctggtgcatcctgttatggtcgcattttggataacccttccagatttcgataaatctctggtttattgtgcagtttatggttccaaaatcgccttttgctgtatatactcacagcataactgtatatacacccagggggcggaatgaaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtttattgcaggaagaggaagaagggttgccgctggtaggtcgtgtggctgccggtgaaccgcttctggcgcaacagcatattgaaggtcattatcaggtcgatccttccttgttcaagccgaatgctgatttcctgctgcgtgtcagcgggatgtcgatgaaagatatcggcattatggatggcgatttgctggcagtgcataaaactcaggatgtacgtaacggtcaggtcgttgtcgcacgtattgatgacgaagttaccgttaaacgcctgaaaaaacagggcaataaagtcgaactgttgccagaaaacagcgagtttaaaccaattgtcgttgaccttcgtcagcagagcttcaccattgaggggctggcggttggggttattcgcaacggcgactggctgtaacatatctctgagaccgcgatgccgcctggcgtcgcggtttgtttttcatctctcttcatcaggcttgtctgcatggcattcctcacttcatctgataaagcactctggcatctcgccttacccatgattttctccaatatcaccgttccgttgctgggactggtcgatacggcggtaattggtcatcttgatagtccggtttatttaggcggcgtggcggttggtgcaacggcgaccagctttctctttatgttgttgctgtttttacgcatgagcaccaccgggctgactgcacaggcttatggtgccaaaaatcctcaggcattagcccgtgcgctggtgcaaccgttgctgttggcgttgggggccggggcgttaattgcgctgctgcgtacgccgattatcgatctggcgctgcatattgttggtggtagtgaagcagtcctggaacaggcgcgacgctttcttgaaatccgctggttaagcgcaccggcgtcgctggcgaatctggtattacttggctggttactcggcgtgcaatatgcccgtgcgccagtaattttgttagtggtcggcaatatcctcaacattgtgctggatgtctggctggtgatggggctgcatatgaacgtgcagggcgcggctctggcgacggttattgcggaatatgcaacattgctgattggtctgctaatggtgcgtaaaattctcaaactacgcggaatctccggcgaaatgctgaaaacagcctggcgaggaaacttccgtcacttgctggcgcttaaccgcgatatcatgctgcgctcgctgttgctgcaactctgtttcggcgcgatcactgtacttggcgcgcgactggggagtgacattatcgctgttaacgcagttctgatgacgctactcacctttaccgcctatgcgctggatggttttgcctacgcggttgaagcacattccggtcaggcatacggtgcgcgcgacggtagtcaattgctggatgtctggcgggcagcgtgccgccagtcggggatcgtagcgttactgttttcggtggtttatttgctggcaggggaacacatcattgcgttgctgacgtcgttaacccagattcagcagctggctgaccgctatcttatctggcaggtgattttgccgttggtcggcgtctggtgttatctgctggacggcatgtttataggcgcaacgcgtgccgccgaaatgcgtaacagtatggcggtggccgccgcaggttttgcactgacgctccttacgctgccgtggctggggaatcatggtttgtggctggcgttaaccgtctttctggcgttacgcgggctttctctggcggctatctggcggcgtcactggcgtaacgatacctggtttgtcgcaacgtgacggttaaaaattctgaataaataatcctaagccaaattgctgactacacttaatctcacgttcagaagaaaagtgaacgtactctcattcacaacctaacgatgaggtcttgattatgaataaagatgaagccggcggtaactggaaacagtttaaaggtaaagtgaaagagcaatggggcaaactgaccgatgatgatatgacgatcattgaaggaaaacgtgatcagttagtgggtaaaatccaggaacgctacggttatcagaaagatcaggcagaaaaagaggttgatagttgggaaaaacgccatgattaccgctggtaattaatccctcctgcccgacatgtacaaggatgtacacccttttagcgaggtttctttttcacctgaatagagtggtcatgatggcactgttcgggatgacgacacgcttctacttctacacatgctgaacataatccatgtgcttcaataacattatgccgcagggcaaaacccatttttgccgccagcgtatgcatgatgtcttccacgccttcagcacattcttctttcaccgcgccgcagcgatcgcaaataaacatggctgaagtatgggtgggctgatcgaacagatgacagagcacataactgttggtggattccaccttatgcacaaaaccttgttcaagcagaaactccagcgcgcgataaaccgttggcggcttggcttgcggttcagcttcgcgcagcaaatcaagcagatcataagcgctgatagcgccatcctgcagactcatcaggcgcaacacttcgagacgctgtggggtcaggcgcacattacgctgtgcgcagattttttcagcctgcgctaataactcctgcgttgtggtcttttccattgggcacctcgacagtggggttaagaatgcccttactttaccatagttctcgcttaaacgccgagaacagggtgtcatggctgtcatattgcctgatcgcatattcgttatgctatagtagcgcccccaatttaccagatgcttaaaaagtcgccatgccagcagaatcacacactgtttatcccgcttaccgtttctcgattgccccgatgcttgactggacggacagacattgccgttatttcttgcgtctgctttcccgcaatacgttgctgtataccgaaatggtgaccacaggggcgattattcacggtaaaggtgattacctggcgtacagtgaagaagaacatccggtagcgttgcaactcgggggtagcgatccggcggcgctggcacagtgtgcgaagctggcagaagcgcgtggatacgatgagatcaacctgaatgtcggctgcccgtctgaccgggtgcagaacggcatgtttggtgcgtgtctgatgggtaatgcgcagctggttgccgactgcgtgaaagcgatgcgcgatgtggtgtcgattccggtgacggtgaaaacgcgtattggcatcgatgatcaggacagctatgaatttctctgcgatttcatcaacaccgtttccggcaaaggtgagtgtgagatgttcatcatccacgcacgtaaagcctggctttctgggttaagtccgaaagaaaaccgtgagatcccgcctctcgattatccgcgtgtgtatcaactgaagcgtgactttccgcatctgacgatgtcgattaacggtggtatcaagtcgctggaagaagctaaagcgcatttgcaacatatggatggcgtgatggtcgggcgcgaggcgtatcagaatccggggattctggcggcggtagaccgagagatttttggttcctcggataccgatgccgatccggtggcggtagtgcgcgccatgtatccgtacattgagcgtgaactcagccagggtacgtatctcggccatattacccggcatatgctgggcttgttccagggtattcctggcgcgcggcagtggcggcgttatttaagtgaaaatgcccataaagcgggtgcagacattaatgtgctggaacacgcgctcaaactggtggcggataagcgttaacttttcaccaaaaagtagtcaaattcaccacgccctgcgccccgtcgcggggcgttttgctgttaaatcaatagattatttttggcatgattcttgtaatgccagcaagagatttcatatttgggagagcatcatgctggaactactttttgtaattggcttttttgtcatgctgatggtcaccggtgtttcgttgctgggtattatcgccgcgctgattgtggcgacggcctttatgttcctcggcggtatgctggcattgatgattaagttgctgccgtggctgctgttggcggttgcggtggtgtgggtgatcagggcgataaaagcaccaaaagtgccgaaatatcagcgttatgaccgctggcgttactaagggattgtgcggatgatcacaacctaaggttttatccttagaacaaaataggaattgataatcaaatctgtcactattgcgcgtcaaacaaattcatcgagctgtaccctacatacagccgaactataaaagaaagggcttcccaggtggaagcccaatttcttttatggaatcaataggctggaaccctgcgtcgcccggctttccagaatctcatgcgcacgccgcgcatccttcagcggatatttctgctgctcggcgacatcgaccttaatcacaccgctggcaatcaaagagaacagttcattactggcctcggttaattcctcccgcgtggtgatatagccttgcagggaagggcgtgtcacatacaacgagcctttctgattgagaatgcctaagttcacaccggtaaccgcacctgatgagttgccaaaactcaccattaagccgcggcgttgcaggcaatccagcgaccgttcccaggtgtctctgcccactgaatcgtacaccacgcgcactttcttaccaccggtgatctctttcaatcgctcgaccagattctcttcacgatagttaataacctgccacgcgcccgcttttagcgcactctgcgctttttgcgcggttcctacagtgccgataagtttcgcgcccagggcttttgcccactggcaggcaatcaagccaacgccgccagccgctgcgtggaacaggaactgttcatcgggtttaatttcataggttttgcgcagcagataataaaccgttaagcctttcaggaaggatgccgcagcttgctcaaaagaaattgccgcaggcagaatcgccgctttatctgcattaatgttatgcacagagctgtaagcgcctaatgccgattgtgcatagactacgcgatcgcctgccttaatatgctttacaccactgccgactttactcacgatgcctgccgcttcggtacctaatccgctgggtagcgatggcggcgggtaaaggccgctgcggatatacgtgtcgataaaattgatgccgatggctttattttcgacctggatttcattctccgccggatcggcaggagtgaactctacggcttgaagtacttccgggccaccgtgcttgtgaaattcaattcgtattgccatttaaactcctttactgagcgacatatctgttttaagcctaacagtagtcgccaggccgcgcggggattttttccgggctgcggtcacaacccggaatatctctgatcagtattgaaacggcgtcgccgcaatccagttttgccactggcgctcaaagttggttagcgttaatacgccccgttcacggcacgggcgagtcctggtttggtaatcattagcttcccgacaaacacaaatcatatattgcctggcatcctgattttctggccgaaaacgccaggccaggagtggcccacctggtgtttgcggtgcaataccggcttcgccatcatagatagccctggcaccacgactcccaccaccgttttcgacataacattgtaaagaacgcagtacagccagcgccagttgcgcactttgtcgccactggaaagattgtgccaggctgttttcatcgcattgaataccttcccggcgaatatcttcacaaagtgttgccagggtttgcgcggcagtgttgatcccctgtgtatgacacaaaattgcggcatggtggctcatggtattttgtatcgtttctcgcacgtcgtcacgtagcagcccctgattcaggtgctgttgcgcctcattaatcgtactgagaatttgttgcctctcgagaggccggtcctggcttttctgatgagcaatatgtaatgcacagcggcgggcgaaaacttgcccggcattgagcgctgctccacctgggcgcgtgacaccatgtgttccggcattttctccggcagcataacaaccagttagcgatgtacgtgcccaaatatcaacttcaattccgccattaagatgttgattatttagcgtaaacttgagcggtgaggctgtgagatcatgaccgtgcatctgatacaaacgaatagccagaggattcatctgtgttaatctcgccagcggttgtgccagcagggcgtgattttgttgcagatagtcgatgacatcatcatccagctcccgcaggttaaatagtgttccgtccgctgcgggttctggttcccgtagaaaatcgagaaaaacatcgcgccctttttgagtctcttcataaactgcgacatccagcaagctggagccatattccagcattcgttccgcgtgaaacggccactggtaacctttgcgaaatatcgcggaggccagcatacgagtcgtggggtaataagttgccagaaaattatactgacgcccggagtggtcctgcgaatagatgcgcggtatcgcctgcatgtaagtaccggaaagattccacggaaactggttgcgcggtgtaccgataccaaactgactttccgtaagattaaccagagttatccctgcttccagcgccatgcccaacgcactaaaacagttcaccggataaacactgtcacgataaagttcaccaggcccgcccgtggctaaaaccagatgctgacagcgaatcactaccattctccagggattatcccgacaggctttatcgatggcgatcaccccctcgactcgtcgattttctccttcaccactggtcaggatacgaatcgccgttgtgtgatcgcaaagaggaatattaaggcgcattgcctcctgggccagcaccttcaccatcaggcgcgatgttcgaggaccgcagctagtggcacggccaaattcatcgtgatcggtttggtaacgcaacgttgcgccaaagagatcttcaggcagatccagacccagatatttcagtacttcacaggtgttcaccgatccgaccgcctcaacatatgcggtgtcatgatccatcgcaccacctgccgccagggtgttacttaatgtcagaaaatggtcaccatttgcacgggtattcgcggtgtgaagcgtttgtttatcagaaccagaacaggcggaagttccccagaaggctttgctggaggcgaccattacatcgacattttgccgtttcagctcgacggcagctcgccatcctgccgcgccactgcccagaaccagcgtgttgcagcggtactcaggtaaaatggtaccgttaaggtcgatactaccgctgacttgagccagcggtgcgtaatggggcattttcacgtcagtcagggaatcgataatagattcagagacattatgcgtcatgggaggtgcccgtagtctggttatgttgggaaacgctgatcgtttcagcgtcggcaagatcatcaagatcacgatcgcgtgtttctggagcaaagaaagtcgcaataatcgtaccaacggtcagcagactaaggtaaatagcgattggcatccaggcagcaataccactgggatcgttagtgtggatcacccaggaaatgattgcagaaccaaccagtggcgcgatccctccggcaataacggcagaaacttcccttgccagtgcgacgccaatataacgatggcgagcaccaaagagttcaggcagaaaagcaccttgtgcaccaaacataccccaggctccaatccctaaggccagagaaagagagacaatagtgacaggaacattaccgtggctgaaagaccaccacaccggaaaggtaatcaacaactgaaaaatcgccagactacgatagacaagaaccctgccgaagcgatcggtcagccaaccggcaataggcaccataattgcaccgactactaccgcagacatcaggcatagcgtaccaactgatttgtccagcccaaccacaccaacgatataactgatcgctaaagcctgataaatcgacgagccgccgttttctgccagacgtaagccaatcccgacgaagacattacggcgtgatgttttcagcaaatttcgtaagggtgattctgtaacttgttgacgagcttcgagttttgcgaatgatggcgattctttaagatgcagtcgaatataaatagccaccgcgataatcaccacgctggagaggaagggcaagcgccaccaccaggtttcggcaagatttgtcacattatgcagcaggatgaagtaaacggcagatgccataaacgtaccaatctggattccgaggaacggcagcgcggcgtaataaccccgtttgccgtcaggagcatattcggtcatcagtacggcggctcccgcctgttcagccccagcaccaagcccttgcagcaggcgtaatgcaataagcataattggcgcccagattcccgctgtttcgtaagtgggtaataccccgatcaacgtgctggcgattcccattaacaacaccgttgctaacaggacgaacttacggcccaaacgatcacctaatgagccgaagataattccgcctacaggtctgacggcaaatccgagaaagtaggtgccaaaactggcgatcagcgccattcccggttcctgattaggaaaaaagagtggaccaaaaataatggcggatgccaggctgtaaagtgcgaaatcgtagtattccagtgcgctgccgagagagcaggtccacgccgcgcgacgcagatctgccgatgaaacattcgctttctctgctggttgtgaaggttgcatgatgtgtctcctttcagacggataaaagaaatccgcctaaaatcaatgggattcttgcgttattattaaaatccaaaatgaaatgctaagttatcgagcactaaagtgcggttgacgcttctcagtaaatgcctgactgccttcatgagcatcttcagtcgtggcggaaaaagcgccagccagtgcttcaagcgtcgaggccacagcaataccttctccggcatcaataacctgcttggcgatctgcactgcaacgggagcacgctgggcgatacgttgtgccagttgcagtccggcgtcgtgtaacgcctccctggcgacaacgcgattcaccagcccgcaggacagtgcccgctgtgcatccagtggttcaccggtaaataccagttctttcaccagtgagcgcccaagcagtgccgtcagccgctgcgttcctgaccagccaggcactgtcgccagcccggtttctggtagtgccatttgtgcttcggcgctacaaatacggatatcggtggtagcagccagttccagaccaccgccataagccaggccgtgcaacagggcgattacgggctgtggcagttgtgccagagcatcaaatgcctgatgaccgcggcggatccagttgcgccacatatcgagtgcagaaagagaggtccagcgatgaatatccgcgccgacacaaaacgctttttcactggcactggtcagcagtactacgcggatctccgaatcagtttccaacgtgtggcaatgcgccagcagttgttcgagcatctctggggttaatgcgttgagttttgccgggcgattaatcaccaaagtggcaatgaaaccgttgcgctggaggtcaatggtgccgttattcatggtgacgtccttgttgaaaatagtggggattcattagtttgagatcgtctgccagacggagtggggcattgctttgggcgagaatgtcgcgttcaggatcaatacctggggcaatttccgtgaccagtagtccgtctggggttaattccagcacgcagcgttcagtgatgtactgcacttgttgcccgagtcttattgcgcgtttgccggagaacgtcacgtgggcgacgtcctgtaccagttttttggctttgccttctttaatgatacgcagctgaccctcttccagttgcagttgggcaccggcattgaaaaagccagagaaaataatgcgcttcgcatgtgaggtgatatcaataaatccaccgcatccggcagtgacatgtggacgagcggggagatgtgagacgttcactgagccatctgcgccgatttgtaaaaacgacatcagagtgagatcaaagccaccgccctggaaataggtgaactgctggggagagggcaaaaatgcttctgcattagaggcacaaccgaactgaaattccagcagtggaactccgccaatcgcgccctgttccagcagccaggtgacgtcaccgtggcgaccttgttccagtaaaatgcgtggtacgttggcagaaataccaaagccaatatttaccgcatctccactttgtagttcttgcgcgactcgctgggcaataactcgcgccgggccatgttccatataacgaaaggctgatagcggacgactgatttcgccggaaatggcaggttcatattgcgtttgtgtcgtttgtgtttgttccggcgcaatcacgatgtaatccaccagtacacccggaatacgcacctcttttggtttcagacttccggcggcaacctgtcgttttacttgcgcaattatgatgccaccattattgcgaacggcagtagcctgttccagtggccccagataagccccttcatgttcataagtcaggttgccgcgttcatcggcagtggtagcgcgaatgatcgccacctgcggcacgatactggggaaaaacagccagtcgtcgttagcaaatcgaacacgttcaaccagagattgttgcgccgctttttcattcattgcaccgccctgcaacaggggatccacataggtatccatgcctgtttgtgtcagcacgccaggacgatgagccgccgcttcccggtgcatatcaaataagatcccggaaggcagattccaggcggggatcgcgttgtcattgatcatttgccagattaacggaggcgccattgatgatggaccggaggggtaggagccagcgatcacttttgccagtaagcccggttgcgccagatgatcgatgccttttacgccatacatatcaccagcggcgatagggtggatggaggtgatgttttgcggatgtccggcacgttgaaagcgttcacctattgctgccagcaccgcatccggacaccccattccactggaggaggagacggtgacaactgcgccatcaacaatcaaatctgcagcttccggtgcagtgatcgtgcgtacagagcacataataatttccttgtttcgatataaaaataattaaaaatatgcatttaaaacaatatgataattttcataaattaattggaacgatctaatttatgcgtaatttgtacgattagggtgtaaaaaacacaacaagggaagtgcgaatctgtgatcgaaacgacgatctcctgcgatcccttgcgttaacggatcgcatgagtaaaaggagattatgataaagtaattgccttgatcttatgggggtttggagcaggcatggcgaagtcggatacaggaagaaagcgggtaacattaaccgatgttgcgcgtgcggctggcgtttcgaaatcgaccgtatcgctggttctcaacgacagttcacttatcaaaaaagagactcaacaaaaagtccagcaagccattgaacaattaggctatgtctataaccgttttgctgccaatctgcgttcgcaaaaatcgctaactatcggcgtagtcattgacgatttgataaatcctttcttcgctgaatttactatgggtcttgagatgacgctggcggagcacggttttatcaccgtgatgtccaatacctcccagcgtagtgaccggcaaaaacaggtgcttgataccttgctggaacaccacgtcgcgggcattgtcctctgtccagtgaacagtacctcagaagccgatttacagcgttatgccaacagttccacacccttattaatcacgatgcgccctctggattggcaacaattgcccgtcgattacgttggcgtggacagccacgcaggtgtacgggaagcgacggaatatctcattcaacaagggcacagagatatcgtgtttattggtggtcttacgcaccatatgcgttatcagggataccttgaggcgatgaatcaccatggtttacagccgtggagtactgatgctttttcgctgcgtgctgaaccgactcaggccaacggctaccagttgatgcaacagctgttggatatgccttcgccacccacagcggtgatttgttataacgatttaatggcttttggcgcggagtcggcactaggcgaaagaggattatttgccggggaagatatttcgttgattggtaatgatggcgtggcggcttgtgcttacagtaacccgccgttaaccacaattgcggtagaaccattggctctggggaaacaggcggcgcagcaaattttacggcgtattgcgcaaccagacgcaccgctcagccattacatctatcgcccgaccctgcaaattcgcgcttccaccggaaagcgggggcgttaaatgctgtagcgagaaactgtttctcgctatactctcttgtcccccattcaacagcaggtaacaccattcgttatggcaggcaatagacctttcaacaaacaacagactgataaccgcgaacgcgatccacaagttgccgggctgaaagtgcctccgcactcgatcgaagcggagcagtcggtgttgggcggtttaatgctggataacgaacgctgggatgatgtagctgagcgtgtggtggcagatgatttttacacccgcccacaccgtcatatctttactgaaatggcgcgtttgcaggaaagcggtagtcctatcgatctgattacccttgcggaatcgctggaacgccaggggcaactcgatagcgtcggtggttttgcttatctggcagagctgtcaaaaaatacgccaagtgcggcgaacatcagtgcatatgcggatatcgtgcgcgaacgtgccgttgttcgtgagatgatctccgttgctaacgagattgccgaagctggttttgatccacaagggcgtaccagtgaagatctgctcgaccttgctgaatcccgcgtctttaaaattgccgaaagtcgtgcaaacaaagacgaagggccgaagaacatcgccgatgtgctcgacgcaaccgtggcgcgtattgagcagttgtttcagcagccacacgatggcgttaccggggtaaataccggttatgacgatctcaacaaaaaaaccgctggcttgcagccgtcggatttgatcatcgttgccgcgcgtccgtcgatgggtaaaacgacatttgcgatgaacctcgtcgaaaacgcggcgatgttgcaggataaaccggtgcttatcttttcgctggagatgccatcagaacagattatgatgcgttctctggcgtcgctgtcgcgcgttgaccagactaaaatccgtaccgggcagctcgatgatgaagactgggcacgcatttccggcaccatgggtattttgctcgaaaaacgcaatatctatatcgatgattcctccggcttgacgccaacggaagtgcgttcccgcgcacgccgtattgcccgtgaacacggcggcatcgggcttatcatgatcgactacctgcaactgatgcgcgtaccggcgctttccgataaccgtacgctggaaattgcagaaatctcccgctcgctgaaagcactggcgaaagaactgaacgtgccggtggtggcgctgtcccagttgaaccgttctctggaacaacgtgccgacaaacgcccggtcaactccgacctgcgtgaatctggctctatcgagcaggatgcggacttgatcatgtttatctatcgtgatgaggtgtatcacgaaaacagtgatttaaaaggcatcgcggaaattattatcggtaaacaacgtaacggcccaatcgggacggtacgcctgacctttaacggtcaatggtcgcgcttcgacaactatgcggggccgcagtacgacgacgaataataattattttatgaattaggtaattaaagcaaacacttatcaaggaacactaatgcaagcggcaactgttgtgattaaccgccgcgctctgcgacacaacctgcaacgtcttcgtgaactggcgcctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtacttttactcgaaggcttttttgatgccagagatctaccgacgatttctgcgcaacattttcataccgccgtgcataacgaagaacagctggctgcgctggaagaggctagcccggacgagccggttaccgtctggatgaaactcgataccggtatgcaccgtctgggcgtaaggccggaacaggctgaggcgttttatcatcgtctgacccagtgcaaaaacgttcgtcagccggtgaatatcgtcagccattttgcgcgcgcggatgaaccaaaatgcggcgcaaccgagaagcaactcgctatctttaataccttttgcgaaggcaaacctggtcaacgttccattgccgcgtcgggtggcattttactctggccacagtcgcattttgactgggtgcgcccgggcatcattctttacggcgtatctccgctggaagatcgctccaccggtgccgattttggctgtcagccagtgatgtcgctaacctccagcctgattgccgtgcgtgagcataaagccggagagcctgtcggttatggtggaacctgggtaagcgaacgtgatactcgtcttggcgtagtcgcgatgggctatggcgatggttatccgcgcgccgcgccgtccggtacgccagtgctggtgaacggtcgcgaagtgccgattgtcgggcgcgtggcgatggatatgatctgcgtagacttaggtccacaggcgcaggataaagccggggacccggtcattttatggggcgaaggtttgcccgtagaacgtatcgctgaaatgacgaaagtaagtgcttacgaacttatcacgcgcctgacctcaagagtcgcgatgaaatacgtggattaatattcgtctccagggagggacaatgtcttattcagaaatcgccgcgtgtctggcatacgcggtttccgtctggctggctgccagaaacaatgtgcatacatggtggatcggcataattggcagcatattgtacggctgggttttttggtctgtgcaactctatgccgacgttacgctccagttattcttcatcgcgaccagcatcactggctggatccactggctgaaaggtcagggtggcgacatcttgccggtgcgccgaacgcaagccagtcactttttccttttgttgctctgtgctgtcgtcgtggcaggcggttacggctttttactccacacctttaccaatgcctgggcaccctggctggattcgttgattttgacctttagcgttctggcacaattcatgttgatgggaagacgtatcgaaaactggttcgtctggttagcggtgaataccctggcagtgccactgtatatgacgcgcggtttaaacctgaccgctggcttatatttcctgttctggattaacgcctggcatggtttgtatcaatggcgcaaagagttgcaaacatcatgaagccttttgcaacgggcctggtggttggtaaattcgcgcctttgcattgtggtcatgaaaagttgatcaataccgcactggcgcaatgtgaagaactgttcatcatcagttattccgtgccggaaatgcctgactgtgaacctgaaaagcgcctgacgtggctgcaagtgcgcttcccgcaagcgacgattttggtactgacgccagagcttgttgcgcgttataacttacctgccataccgcataacgatgccgacatccaccgtcattatgtggcgacgctgtgcctgcagatattacgctgtcgtccacatgctgtatttactgcagaagactatggcgatggctttgctaacgtgctggcgcggcgttttgcccaacccgttgaacacgttcgaatggcgcgcccagttggcgatgaagcgccttcgggaacgcttattcgttccgatgttcaccgctatcgctacatgttggcgaatgatgtttattacagtttcgttcgccgtatctgtctgcttggtggcgaatctaccggtaaaagcacgctttcaaaagcgctggcggatgggcttgatacggtgtatgtcgctgaatttggccgcgactattgggaagaaaaaaacggaatcttaaccgcggatgatttgttgcatatcgcctgcgaacaggtacgccgggaacaacaagcagaagctaatcactatcttatatgtgacacgtcgccactcacgaccttgttctatgcccttgatcaatatggtcatgctccgcaagaacttcatcaactggcggagcgggaatactctctggtggtgctttgcggcgcagaatttcccttcgtgcaggatggcacccggcaaggagaggtatttcgcgcacggcaacaggtgtggtatgaacaggaattatcgcgcaggaatattccttatctttctgtttcgggttcgctgcaagagcgactggggcaaattctacatcgccttcccgactgactttgaacatccactcgatcttcgtctacttccggtttattgtgttttaaccacctgcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgaaagccgtagcggatgcggaagcgcgcctgaatgcgcagcctcatggtgcttcgctttatttaccgatggaagggcttaacagctatcgccatgccattgcgccgctgctgtttggtgcggaccatccggtactgcaacaacagcgcgtagcaaccattcaaacccttggcggctcaggggcattgaaagtgggtgcagatttcctgaaacgctacttcccggaatcaggcgtctgggtcagcgatcctacctgggaaaaccacgtagcaatattcgccggggctggattcgaagtaagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgaccagtgggattccgtgattgaaattctcaaagcccgcgagcttattccattcctcgatattgcctatcaaggatttggtgccggtatggaagaggatgcctacgccattcgcgccattgccagcgctggattacccgctctggtgagcaattcgttctcgaaaattttctccctttacggcgagcgcgtcggcggactttctgttctgtgtgaagatgccgaagccgcaggccgcgtactggggcaattgaaagcaaccgttcgccgcaactactccagcccgccgaattttggtgcgcaggtggtggctgcggtgctgaatgacgaggcattgaaagccagctggctggcggaagtagaagagatgcgtactcgcattctggcaatgcgtcaggaactggtgaaggtattgagcacagagatgccagagcgcaatttcgattatctgcttaatcagcgcggcatgttcagttataccggtttaagaaccgctcaggttgaccgactacgtgaagaatttggtgtctatctcatcgccagcggtcgcatgtgtgtcgccgggcttaacgcgcaaaatgtgcatcgcgtggcaaaggcgtttgctgcggtgatgtgattttaatcaacaggcggatctctccgcctgttcctgactccagccatcccctactattctgtcccttttttcgcccacttttacatcatctcttttctataagtttttgaaaattagtgtttttaactgttggtacggattgtgcagtaatgcggctgtctatgaccatcaggagaaaaacatggagaacatgacctcgcccggcacgctgcttagtggagataacgcgacctggcttgaagagtactaccagacctggttgcgtacgccggaacaactcccggaagactggcggcgtttttttctttcacctgaactgactgtccaaagcgtatccggtgataacaacgtcagcggtgcgacgttaaaaaaacaggctgcggtaatacaactgatcaatgcctggcgcacgcaggggcatctgcgcgcaaagcttgatccacttggtttgaatcccccagctgacgttccctccctccagcctggtttttggggattaagcgaagaagacttgttgcaggagtttagcgtcacctttggcgcacacaccacgcaaatgccacttaagcaactgcttaacctgctggagcaagcctgggccggtagccaggcttatgaacttgctcatctggaaaatcgtgaagaaatcaactggttgttatcacggattgagagcagcaatgcgccacaagctgatgcccaaacctgcattgcccgttttgaaaaactgatggcggcagagacgttagagcgttatctgcatacccgttatgttgggcagaaacggttttctctggaagggggcgaaagtgcaatcccggcgctcgatacgctgacaaaacgcctgcgtgcgcaaggtgtggaggaaatggtcattggcatggcgcaccggggaagacttaatgttctggttaatctgttgaataaagacccggcacagctttttgctgagtttgaaggcaagcagacgatcggcagtggttcaggcgatgtgaaataccacatggggtattccagcaatctggaaacacctgccggttcgctgcatgtggcgctggcgtataacccctcacatctggagatcgtgaatccggtggtgctgggccaggtgcgagccaggcaggaacgccgtggtgaggatggtcaggcaaaagtggtgggcgtacttattcatggggattccgcgttgggcggcctcggcgtcaaccaaaccacgtttaacttatcgcagactcagggctacggcactggcggtacgctacatctggtgattaacaatcagattggcttcaccacttcccgcttgcaggatatgcgttcttcacggtactgcaccgatattgccaaaatggtagcggccccaattatccacgttaatggcgatgacgttgacgctgtttgccaggtaatggaactggcgtgcgaatggcgagacaccttccggcgcgacatcatcatcgatatttgctgcttccgtaagcacggacacaacgaaagcgatgagccacgtcttacccagccacaaatgtatcaggcagtggatgctcaccctggtacgctcgcccgttatggtgaatctcttgcccgccgcggcctgttaactcaggcgcaacaagatgagatgacggcacgctatcgcgactggctggatagctgccagaaacgtgaaccgcagcctctcaaacctgcaattcactcttttagcgctaactggtatgggttgaccaaccctcactggagcgccccggtatctacggcattgcctcggcaaaagctggcagcgtatggtgaaatcatttctacactgccacccgatgtggtcgcacatcctaccattaaacggcaactggcgttacgccaggatatggccgcaggtactcagccaatagactggggaatggctgaaatgctggcctatgcatcgcttgtggatgcgggtgttggtgtgcgtctttctggtgaagactcagggcgtggcacgttcagtcatcgccatgcagtggtacatcatcaaactgaagcccgtcgttatctgccgttacagcatatccgcgctggtcaggcatctttcgatgtttatgattcggtgcttaatgaagaagcgctcttagcctttgaatatggctattcaacgtctgcgcctcagcaactggttatttgggaagcgcagtttggtgactttgccaacggcgctcaggttgctattgaccagtttatctcgtctggcgaaaccaagtgggatcgctatagcggtttaaccattcttctgccgcatggctatgacggacaagggccggagcactcttctgcgcgtcctgagcgctggctgcaactgtgcgcagaaaacaacatgcaggtggtgatgcccagtgagtcagcacaaatgttccatttgctgcgcggtcaggcattacgcccaatgcgcaaaccgttagtgataatgatgagtaagcgtttacttcggtttaaaggcgctatgagcgagctttctgaattcactgatggcgcttataaaccggtagtcaccgatccgcaattgcatcagtcccagaaagttaagcgcgttattttgtgtagcggccaggtctattacgacgtactggaagcccgtaagcagcgtgagtgtgaagatgaggtagcgattgttcgcctggagcaactctacccgttcccggtcgcagaactgaatgatgttctggcgagttggccgaactgctgcgaatggatttggttgcaggaagagccagaaaaccagggcgcgtggcggcagattcgtcatgagctggcggcactgaaaattaacactccttactggcagtatgcaggccgcccggcagtggcagctccggcgacagggtatgggcgtgtacataaacaacaaatcgacgaatttcttgctgctgcgtttgcagatattcagccatgaaaggcgcacaaaaataataaggagaacattttatgatcgaaattactgtccctgtattaccggaatctgtcacggaaggcacgctgacaacctggtgtaaacaagaaggcgagcacgtaaaacgcgatgatgtgattgccgagctggaaaccgataaagtcattctggaaataccggccccgcacgatggcgtgttaagcaatattatcgtcagcgaaggtagcacggtcacgtccgcgcaactgttggcgcatcttaagccgcaagctgtcatagaagaaaccgtcacaccagtcaccgaaaccctggcgatgccttccgcacggctggaggcacagcgtagtggtgtcgaacttgctgacgttgcggggagcgggagaaatggacgtatcctgaaagaggatgtacagcgcgttactcctgcaccagtcattcagcctgaacgggtggcggagatcgcgccagctaaacccttgacaccgggtgctcgtcaggaacgtcgtgagccgatgtcgcgcttacgtcagcgaattgctgagcgtctgctggcttcccaacaaaataacgccattcttaccacattcaacgaagtaaacatgcagagcgtgatggatttacgcacccgctggaaagatcgttttgccgagaagcacggcgtgaagctgggctttatgtccttctttgttaaggccgttacccgggcgctggagcgcttccctgtagtgaatgccagcgttgatggcaacgagattatctggcgtgattattgcgatatcggcattgcagtgagcagcaaccgcggcctggtagtgcctgtgttacgcaatgcgcaatcactctctttggtggaaattgaacggcaaattgccgaatacgccacacaggcacgcaatggcaaattgccgctggaggcgttacagggcggcacgttctctatcaccaacggcggtacttttggttcgatgatgtcaacgccaatcattaacccgccgcagtcggccattcttgggatgcatgccatcacgccgcgcccggtcgcagaaaacggccaggttgttattcgtcccatgatgtaccttgctctcagctatgaccatcgcattatcgatggtcaggaagccgtgcagacattggtggcaatacgtgagctactggaatcaccggaacaactgttgctggatctttaaggagggcgccgatgagtacaatttttgatgtggcagttatggggggtgggccaggtggttacgtagcggcactgcgggctgcgcagaatgggctttccgtagtatgtattgatgatggtgttaatgcacagggcgaaccttcgccgggcggtacgtgtctcaatgtcggctgtattccgtcaaaatcgttgctgcaatcttccgagctgtacgcgcaagtacagcatgaggcaagcattcatggcgttaacgttgaaggcgtatctttcaatgctgccgcgatgattcaacgtaaagatgccatagtaagccgcctgacaatgggcatcagcttgctgtttaagaaaaataaagtgaagcacttgtgcggcctcgcaacgttagaacgtgctcaggatgagatttggcaattacgcgtaaacgatcaacacattcacgcccgtaatgtagtgattgcaacaggttctcagccgcgtcagctgcctggcgttaccattgataatcaacagatcctcgacaatcgtggcgccctggcattgagcgaagtgccgccgcgtctcggtgtgatcggcgctggcgtgattggccttgaactggggtctgtgtggaatcgggtcggttcagatgtcacgctgctggagatggcgccaacgttcttgcctgcactggaagctcgcctgtcgaacgaagtccgtaaagcaatgattgccagtgggatgaaaatgcaactggcagtagagattgaggctattgaacaacgggatgacggtgtgcatgtgcgctggcggcagggtgagaagcgagaagaaagccgcttcgataaattaattcttgccattggacgtgtaccgcgactttctggtgtcgatctcgtgcaactcggtcttgaagccgataaccgtggcggtattgccgtcgataacttatgccgtaccgggaaagccgggctgtgggcaattggtgatgtcgtgcgagggccgatgctggcgcataaagcgatggctgaaggtgtggtggttgcggatcaaattgccggactggcggtagagccgattaattttgcgctgatcccttcggtgatttacacccaaccggaagttgcgtgggtaggggaaaacgaggcctcactgaaagccgctggcagagtctttaacaaaggaaattctctgtttgccggtaacggtcgcgccttagcattaggccaggaaggtgggcgttgcacgttatacagcgataaacacactgaccgcgtacttggcggagcgattgttggcccgcaggcatcggagctgatcaatgaaattgcgctggcgatgacttttagcgcctctggcgaggatattgcctgtgcgatccatgcgcatccgaccttaagcgaagtcatccacgaagcagcaatggccttgaataataaagcattacacggataacacataccactgagggaatatatgaatttacatgagtatcaggccaaatcgttactggctggcatggggatgccgtgtccaaaagagatagccatccaacagatttcgcaactggcagatgcctggcaacatattgcttgcccgagtaaaggcgcggtacttaaagcgcaggtacatgctggtgggcgcggtaaagctggcggcgtaaaagtgcttaagcagctgccggaagcacaggcttttgtacagcaaatgttgggatcgcaactggtgacttatcagaccgggccagaagggcagtatgtcagcagtattttgctgtgcgaaaacatctatccggtacgccaggaactctattttggcatggtggtggatcgtgaaagccagcgggtcacgtttattgtcagcccggaaggtggtgtggaaattgaaaaagtcgcccatgagacaccggagaaaatcagcagtgtcagcattgatccactgacaggcgtgcagccttgccatatccgcgaaatgtttgctgttctgcaactggaacacgggctatttgctacctttagtcgcctggttaatcaggcgtggaaagcctttaacgaactggatttcgccctgctggaaattaaccctctggtgttgcgggaaacgggcgaatttatgtgtgcagacgcgaaagtatcgctggatgataacgcgctgtatcgtcacccggaactccaggtgctacgtgatgaaacccaggaagatccacgcgaaagccaggcagcgaagcttgatcttaattatgtctcgctggacggaaatatcggctgcatggtcaatggtgcagggctggctatggcaaccatggacatcatcaagctatacggtgaacaacccgcaaacttcctggatgttggcggtggcgcaacccaggagcgcgtcagtgaagcctttcggctgattgtttccgacagcaaagtgaaagccattctggttaatatttttggtgggattgtccgttgcgacatgatcgccagagccattattcatgctctgaatgaggcccgtatcaccctgcctgtcgtggtgcgtctctccggtaataacgctgccgaagggcagcggttactggcagaaagtggcctgacggtggaagccgtcaattctctggatgatgccgctaaacgcatcattgcgttactgaattaacaggaggttaagatgagcgttttgatcaacaaacacacgcgggtactggtgcagggcattaccggcaaaaacggcacatttcatacagagcaggctattgcgtatggcacgcagattgtgggtggagtgacgccaggtaagggcgggcaacggcatctggatcgcccggtttttgattcaatgaaagaagcgatgcgacaaactgaggctgatgccagcgtgatttatgtgcctgcaccgtttgtgctggattctgttgttgaggctattgaagctggcgtcaaattggttgtggtgatcactgaaggtgtaccgacactggatatggtgaaagttcgtcggctgcttgactgccacccggatgtgcggctgattgggccaaactgcccaggagttatcacgccgggcgagtgcaaaatcgggattatgcctggtgaaatccaccgcccagggcgtattgggattgtttcccgctccggtacattaacctacgaagctgtagcgcaaaccacggcgctgggacttgggcaatccacctgtattggtattggcggcgatccggttccggggactaactttattgatgcgctgcgtttattcgaaaatgatccgcaaacagacgcggtaattatgatcggtgaaattggtggtaatgcggaagaacgggctgcggaatttattcgtcatgaaatgaataaaccggtcgtaggttatattgccggtgttactgcaccaaaaggaaaacgcatggggcacgccggagccattatttctggcggtagcggcagtgcagaggataaattccgtgcgttcgataaagcaggcatggcatggacaagaaacccggcgttgcttggcgaaacgttatggaatgttattaagtaatccataaatgaatatcaagggagcatatcgctccctttttttatctgtgtggtaagggaatcatcttttaataactgtgcggaaaaccgcgcataaaataaaaaggataaatagctaactcattaaataacaaagcgttattaaaaaattaaagatggcatagctcctgcaatagccaggcaggttttttatttttcacaatgaggtgaatatgtcatcaatatcccatggcgcaccacaaaagcgtcgaattatccctaatcccggcctgtggttggcgatcattgccggaattattattacccttctgccactgggcgataccttgcccgtcgccggacaaaatatgatcgccattctggtgtttgccattattgtctggatcagcgaagcgatggattacaccgccagtgcaattgttatttccgcactgattatctttatggttggttttgccccggatatgaatcacccggacacgatccttggcaccgcgaaagcgctgaaaatgactctgtcgggtttttctaattctgctctggcgctggtggcagcagcaatgtttatcgcggcggcaatgaccattaccgggctggataaacgcattgcgctgtttactatgtcgaaaataggtgccagcagccgcagcattattatcggtgccattgtggtgaccatcgtcctgagcctggttgtacccagtgccactgcccgtacggcttgcgtggtgccgattatgatgggggtcattgcggcatttaaggtggataaacattcacgtttagcggcgtcaatgatgattgttatcgcccaggcgaccagtatctggaacgttggtattcaaacttcggcggcgcaaaacctgctttctatcggttttatcaataaaactttcggcgccgggcattctgtcagctggcttgactggctgttagcgggcgcgccctggagcctcaccatgtcggtgatcctctatttcctcgcacgtaaattgttgccgccagaaacggaagctgttgaaggggggagcgaggccattaaaaaagcactcgcagagttagggccaaccaccggtaaagaaaaacgcttgatcggtatttcgctattgttactgctcttttggtctactggcggaaaattacacagtattgataccacctctgtcacccttgccggactggcgattatgttgctgccaggcatcggtgtaatgagctggaaagaggtcgaaaaacgtgtgcagtggggcacgttgctgatgtttggtattggtatcagcctagggtccacgctgcttgatacgcaggcagcttcatggatggcgaactatgtggtgaaaggttttggtcttgatggcttgccatcattagccatcttcgcgattctcgccgctttcttgataattattcacctggggtttgccagtgccactgcgctaactgccgcattgctgcccatcctgattagcctgttaagcagtctgccgccagaactcggcgttaacccggtcggcatgaccattctgctcgccttcagtgtcagttttggcttcatcctgccgattaacgcgccacaaaatatggtgtgtatgggtacggataccttcacgccacgccagtttacccgtgtgggactgtacctgacggtaatcggctacctgttgttgctactgtttgccgccacctggtggaaaattttaggtctaatgtgaggaaaccaacgatgtcattacaaattgctgttgaaaaagtgcgttggttagctgccgggctgctggaacttaatggctgtgatgccgatatcgctcaggatgtggcggaacatatgattgaagcggaacgttatggctttgccagccacggcgtcacgctgctaccgaaatatctggaaaatatcgctcgtggcgatgtaaccgcgaatgcccgcccggaatgcttaacaagtgaaggtaatttacaacgttttcatgcccacaatggctttggtcaacacgccggaaaagtggcggtaaatgctgccatcgaacaagcaaaacaccgcggtttttgcctgttaacgttgtgccatgcgcatcatttagggcgtatggggcattacgggcaaatggttgctgatcaaggcctggcgatgctggccatgagtaacgtcaccgggcgtccggcactggtcgccccgtggggcggtgcggaaccgcgtatgaccactaaccctttctgctttgcctggccgttcagtgatgggcgtccgccgattctggttgattttgccaccagtagcatggcgctaaataaagcacgggtaatgtcgtccaccgggaagcaggccgcgccgggacaattgatcgatgcacaggggaatccaagcaatgatcctggggtgttattcagcaatcctccaggggcgttactgccatttggtgagcataaaggatttggcctggcactgatgattgaaatgatggcggggatcttatctggtggtgacacgatcgccgaagatcatcagacggatggatctgcgcataatcatctttttgcgttgattatcgatcctgatcaattcaccgatctggcaggggagaaagggcagttctttgcggattatctgttagctacgcagcctcaacctggcggcaatccggtgatttaccccggtatgccagaagctgccaaccgggaacgcaatgcgaagatgattacgatcccggtatcattctggtcctggatagttgaacattacgcccgcaaaggtatcgatttggggttacatcctcaggaatcagcattagctggatgattctggtcgataaacttgcggttgaatctgatgtttgttgagtttgtcatataaagtcttgcgcggcagctgtaatagccgcgctgtcaaactgacttggccttccgtttgtcgcagcatatcttcgattaactttttctcgaaagcatcaatgcaggcggtaaggccactctcttcttgctgagtcattggcactggctggtggtgggtcagtaaaccgagaacaaaacgctctgcattgtgtttaagttcacgtacattgccaggccaactttgtgattgcaaccaggccagtaacatgggagaaatatcaggcagaggacgattatatttttgtgccgcctgactggcgaaccagtaaaacagttcagggatatcttctcgtcgctggcgtagaggtggaatattcaagctaaccacattcagacgataatagagatcgagacgaaacagatgttcttcgctgcgacgcagtaaatcttccttggtcgctgcaataacacggcaattcaccggaattaattgattggcacctaatcgttcaatggttctttcctgcaatacacgtagcagttttacctgcattcctgatggcattccctctatttcatcgagaaataacgtaccaccatttgcatgttcaatttttccaatacgctttttaaccgcaccggtaaatgcgcccgcctcatgaccaaatatttcgctttcaaacaacgtttctggtaagcctgcacagtttaaggcaacaaactgcccctgacggcgggtactccagtgatgcagcattctggcgacgacttctttaccacaacctgtttcaccataaataaggacatcggcaccggtatctgcgacattaaggatcattttacgcagttgttgcatctgcggactacgaccaatcagcaccgggccattttcctgttgcagattcgccagtaattgctgattttctaaaaccaatcgccgtttttctaccgctctggcaataatactcaataatttatctgagctacttggtttctcaatgaaatcgaatgcaccattacgcatggcatccaccgccatttccacgtcaccgtgtccggtaattaaaataaccggaattttgctatccatttcgttgatgtaactgaggagctctagtcctgatattccaggtaacctgacatcggtcagtataataatgttggcttgactttgaataaggggaatactgtgttctgcatcgcaacaggaaataacacgataaccagccagcgtgagcgtttgttcacaggcaaaacgtacatcgtcactatcctcaatataaactatagtaatttcactggatttattattcatgttcttctccccattcaggccaggttaatgtcattactgcgccgccttcaggatgattactggcgtggagtgcgccgttcgaatttcggacaatttcgctgactattgccagtcccaaccccattcctctacgtttagtggtaaaaaatggttcaaatatgcgatcgacaacttcaggtgcaaaaccgccaccgctgtctttaatggtaataataactttgttatttgcctggcgaatggcgatatccagtcgtttgtaagagctaccttccatagaatctaaggcgttgctaattaaattactgaatatctgttcaagaccgagctcatcgcaattgacaaataacggcatggatggggcttttattcgtcgctcaatgttatttttctccatgctgtgattaagtaacgccacggcgctatacatcactttgatgacatcggcagaacctttaggtacgcgatggcgcgaggcaaatgctttaagttcggaaatgagctgcgtcatccgctcaatcactgaaataatgtgtttcagattctgttcaacctgcggatacatctctttttttagcatagtacgcgcgttatcagtaagtgcgtgaatggcggctaacggttgattttgttcatgggcaatttcggttgccatctgtccaagcgccgccagtttgctggactctgccagttcactacgcgtaatttgtaatacttgttcagcctgactgcgctcttttatctcctgtattaatttttgattgatcaattccagggcagatgtacgctctttaacctgtttttctaatgtttcattcgccagtgttaataattgttgtgcatgagatcgcattctccagtatttaataaataacaaaaacagcaggtaaataattagtgtaatgactaacgaaatagcccatgaccagtacaggttatctaaggggaccataattgtcattttccagttaaattctggaatggctatttgttgcgtataatattgcgggaataaacagagttgttcttttttatctttcaggaaagtaaaattgctcacggtataacagggataataatccgccggtaaaagattgtcgagactatattgacgggtagattgtagtttttgtttttcctgaacaggtaacggttgcagtgttcgcattcgccatggcgattttgaacttaaaaatataatcccatgttcatcattcacgataatattttcaggaccttcggcccatgctttttcaatttcattaagacttatttttactactacaacaccgacaatttttcctttatcttttatacttgtagagaggaagaatcccggtgtatttgtagtgctaccaataccgtaaaagcgtccatttaagccagacatggcgtgtttataataggggcgatagctataattttgccctacatagctgccggggtcctgccagttgctagaagcgatggccttaccttgggtatccagaataaatattgctgcggttttgagttgagtattgaaatgtgcaattcgttgattgagttcgctggacgtcatatcgtcaggcgtaattaccgcctgacggatgatatggtctgttgagagcatatagggtaaaacataaaattgctcgatggtggaatataatgtggacttatacatttcaagccgcattttatcggtaccggacaaggtattaaaacgcaagtgcaaaaaagcgattgaaaccgcgagcatgataagaaaaagtgaaatgcttgtaatgtgaaatcgccatttgttcttaaatatataattccacgatattttcattcatcatccattgaatgcatttatatttatcatcagtatattccctgaacaatgtttgcgagaaccaaaagagtgccattgtgtgaatgtgtaagcagaataaccgtggcaatgtgtggtttatcgcacaggtattccaaatgtgatcatgctctttttatgtgacaaatccgcagataatccttcctttcccccgcggttggcgttatggtcagatggttttttcaacaaacgcacaataataagtttcaacttactgactatttagggaaaaatatgcgcaagatcacacaggcattgagtgccgtttgcttattgttcgctctaaacagttccgctgttgccctggcctcatctccttcaccgcttaatccgggtactaacgtagccaaactcgctgaacaggcgccaattcattgggtttcggttgcacaaattgaaaatagcctcgcaggacgtccgccaatggcggtggggtttgatatcgatgatacggtacttttttccagtccgggtttctggcgcggcaaaaaaaccttctcgccagaaagcgaagattatctgaaaaatcctgtgttctgggaaaaaatgaacaatggctgggatgaattcagcattccaaaagaggtcgctcgccagctgattgatatgcatgtacgccgcggtgacgcgatcttctttgtgactggtcgtagcccgaccaaaacagaaacggtttcaaaaacgctggcggataattttcatattcctgccaccaacatgaatccggtgatctttgcgggcgataagccaggtcaaaatacaaaatcgcaatggctgcaggataaaaatatccgaattttttatggtgattccgataacgatattaccgccgcacgcgatgttggcgctcgtggtatccgcattctgcgcgcctccaactctacctacaaacccttgccacaagcgggtgcgtttggtgaagaggtgatcgtcaattcagaatactgacagagcgggagagcgtaatactctcccgaatgctgtttttttaatcacacctttatcctttcgctgtcttgctgcaaactgattaagagagttttatcaaggagcagcacatgtggtatcaaaagacgctcacgcttagcgccaaatctcgtgggtttcatctggtaacggatgaaattctgaatcagctggctgatatgccgcgcgttaacatcggtttactgcatctgttgctgcaacatacctccgcctctctgacacttaatgagaactgcgatcccaccgtacgccacgacatggagcgttttttcctccgcgccgttcccgataacggaaattatgagcatgactatgagggagcagacgatatgccttctcatatcaaatcctcaatgctgggaacatcgcttgtattgccggtgcataaagggcgtattcagaccggcacctggcaaggcatctggctgggggaacatcgcatccacggcggatcgcgtcgcatcatcgcgacactacaaggggagtgaaaaatgaccatttcggagttgctacaatattgcatggcaaaaccaggcgcagaacagagcgtgcataacgactggaaagcgacgcagatcaaagtggaagatgtgctgtttgcgatggtgaaagaagtagaaaatcgcccagctgtttcgctgaaaaccagcccggagctggcggagctgctacgtcagcagcacagcgatgtgcgtccaagccgccatctgaataaagcgcactggagcaccgtgtatctcgacggttcgctgccggattcgcaaatctattatctggtggatgcgtcttatcagcaggcggtgaatttgctgccggaagaaaaacgtaaattgctggtgcaactctgaaagaagaaggccgctctgaaagcggccttaacgattacagcatcggcttgaggaagcgcgccgtatgcgaagcttcgcactctgcgacggtttctggcgtaccggagacgaggatttcgccgcccccactgccgccttccggtcccaggtcgacaatccagtcagcggttttgatcacgtcgagattgtgctcaattaccacaatggtattgccctgatcgcgcagtttatgcagtacgtcgagcagttgctgaatatcggcgaagtgcagaccggtggtcggctcgtcgagaatatacagcgtctgcccggtgccgcgttttgacagctcacgcgccagcttcacgcgctgggcttcaccaccagaaagtgtggttgcggactgcccgaggcgaatgtacgtcaggccaacgtccatcaacgtttgcagcttacgcgccagagctggcaccgcatcaaagaactcacgcgcctcttcgatggtcatatccagcacttcgtggatggttttgcctttgtacttaatctccagcgtttcacggttatagcgtttgcctttgcactggtcgcacggtacgtaaatgtccggcaggaagtgcatctccactttgatcacgccgtcgccctgacaggcctcgcagcgtccgccacggacgttaaagctgaaacgtcctggcgtatagccgcgcgcacgggattccggtacgcccgcaaacagttcgcgcacaggtgtaaacacgccggtataggtcgccgggttagaacgcggagtacgaccaattgggctttggtcgatatcgatcactttatcgaaatgctccagtccctgaatatcgcgatacggtgccggttcggcgatggtcgcaccattcaactggcgttgggcaatcgggaacagtgtgtcgttaatcagcgtcgatttaccggaacctgaaacccctgtgatgcaggtaaacagacctaccggcagcgtcagcgtcacgtctttcaggttgttgccgcgtgcgcccgtcagtttcagcactttttctggattggcgggtacgcgtttcttcggcacctcaatcttgcgtttaccgctcatgtactgcccggtcaacgactcaggcaccgccataatcgcttccagtggaccttccgcgaccacttcaccgccgtgaacacccgcacccggaccgatatcgatcacatgatcagcggcgcgaatcgcgtcttcgtcgtgctccaccacaatcacggtattaccgagatcgcgcagatggataagcgtacccaacaggcgctcgttatcgcgctggtgcaggccgatagacggctcatccagcacgtacatcacgccaaccaggcctgcaccaatctggctcgccagacgaatacgctgggcttcaccgccggaaagtgtctctgctgagcgggaaagtgtcaggtaattcaggccgacgttaacgaggaatttcagacgatcgccgatctctttaaggattttttctgcaatcttcgcccgctgacctgcgagtttgagattgttgaagaattccatcgcatgaccgatgctcatgtcggagatggcgggcagcggcgtattctcgacatacacgtggcgtgcttcccgacgcagacgggttccttcgcagctggcgcacggacgattgctgataaacttggctaattcttcacgtaccgcgctggattccgtctctttataacggcgctccatattgtgcagcacgccttcgaacggatgacgacgaatggaggtatcgccacgatcgttcatgtatttgaattcaatgttttctttgccagaaccgtacaacaccactttatgcacgttcgcgctcaggctgccccacggcgcttcgacgtcgaacttatagtgatctgccagcgatttcagcatctggaaataatagaagttgcggcgatcccagccacggatcgcaccgccagccagcgacaattccggattctggatcacgcggtcaggatcgaaatattgctgtacgccaagaccgtcacaggtcgggcaggctcccgccgggttgttaaatgaaaacaggcgaggttccagctcgcgcatactgtaaccgcaaatcgggcaggcaaagttggcggagaacagcagctcttccgctttcgggtcgtccatatccgccactaccgcggtaccaccggaaagctccagcgcggtttcaaacgactcggcaagacgttgggtaagatcgtcacgcactttgaagcgatcaaccaccacttcaatggtatgtttcttttgcagttccagtttcggcggatcggaaagatcgcagacttcgccatcaatacgagcacggatgtaaccctggcttgccaggttctccagcgttttggtgtgttcgcctttgcgctctttaatgattggcgcgagcagcatcagacgcttgccttccggctgggacaacacgttatccaccatctgactgacggtttgcgccgccagcggtacatcgtggtccgggcagcgcggctcaccaacgcgagcgtacagcagacgcaaatagtcgtggatttcggtgattgtccccaccgtagagcgcgggttatgagacgtcgatttctgctcaattgagatggcaggagaaagcccttcaatatggtcgacgtccggcttctccatcagtgacagaaactgccgcgcgtaggcggaaagggattcaacgtaacggcgctgcccttcggcatataaggtgtcgaaagcgagcgaggatttgccagaacccgaaagcccggtcacgacaataagcttgtcgcgggggataacgaggttgatgtttttgagattatgggtgcgggcgccccgaacttcgatcttatccattcacctttcccggattaaacgcttttttgcccggtggcatggtgctaccggcgatcacaaacggttaattatgacacaaattaacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattcagaacgatttttttcaggagacacgaacatggccagcagaggcgtaaacaaggttattctcgttggtaatctgggtcaggacccggaagtacgctacatgccaaatggtggcgctgttgccaacattacgctggctacttccgaatcctggcgtgataaagcgaccggcgagatgaaagagcagactgaatggcaccgcgttgtgctgttcggcaaactggcagaagtggccagcgaatatctgcgtaaaggttctcaggtttatatcgaaggccagctgcgtacccgcaaatggaccgatcaatccggtcaggatcgctataccacagaagtcgtggtgaacgttggcggcaccatgcagatgctgggtggtcgtcagggtggtggcgctcctgcaggtggcaatatcggtggtggtcagccgcagggcggttggggtcagcctcagcagccgcagggtggcaatcagttcagcggcggcgcgcagtctcgcccgcagcagtccgctccggcagcgccgtctaacgagccgccgatggactttgatgacgatattccgttctgatttgtctttaaaacaatagggtatattgttttaaggtggatgattaaagcatctgccagccataaaaaagaagcctccgttatggaggcttctacatatcaagtcaaaatcattggccattgtggcggtgtctgattcatctcttctatcatcaccgactcgatgttgtgccagatggcggtgatatccgccattgtgatgccaagcaaccccattgcgaaccagcaggcggaaactacgcccagaccgctgctgatcactgcaagcccgacataatcagcccgacgaaaacggatgttgagcgtgctagccagaaacatcattacggcactaagaagttgccagcgaagaagaaccacgccagtggtgagggtagccatcaaacaattcctcggaaaagagctgatgccctggacagcgcggcgttgttcacgggaggcgtgatacactctggctatcgcggggcttgcagaacacaaaaatgaaacactctgtttgtttcatgaattttgtgaactatatcacaattggttgtttgttagccagattaggccgtgacttttattgccgtacagattatgtgttttttcagcggcattaagggtatatcttcccgccgcctctgcattcctgaaggtgattaatttttaagatcaatgaattatcgtcatcctggtgacgattaaaaaggtctcaattttatatcaggcaaaagtgctatttataccgtaagatttatctaaagacgtcggtagccagggtttcaccttgcaataaccgggtataaacaggcagggaattgatagtaatgagtcatcgtgcacgacaccaattactggcgtttccgggcattatctttttagttctctttcccatcattctgtcgctatggattgccttcttttgggcaaaatcagaagtgaataatcagctccgaacctttgctcagctggcgttggataaatctgagctggtcattcgtcaggcagatttagtgagcgatgcagctgaacgctatcaggggcaagtttgcactccagcccatcaaaagcgaatgttgaatattattcgtggctatctttatattaatgaattgatttatgctcgtgataaccattttttatgctcatcgctgatagcgtctgtaaatggctatacgattgcaccggccgattataagcgcgaacctaacgtttctatctattattaccgtgatacgccttttttctctggctataaaatgacctacatgcagcggggaaattatgtggcggttatcaaccctctcttctggagtgaagtgatgtctgatgatccgacattgcaatggggagtgtatgatacggtgacgaaaacctttttctcgttaagcaacgaggcctcggcagcaacgttttctccgctgattcatttgaatgatttaaccgtacaacgaaatggctatttatatgcgacagtttattcgacaaaacgcccaattgcagccattgttgcgacttcatatcaacgtcttataactcatttttataatcatcttatttttgcgttgcccgccggtattttggggagtcttgttctgctattactctggctacgtattcgacaaaactatttgtctcccaaacgcaaattgcaacgcgccctcgaaaaacatcaactttgcctttattaccagccaataatcgatatcaaaacagaaaaatgtatcggcgctgaagcgttgttacgttggcctggtgagcaggggcaagtaatgaatccggcagagtttattccgctggcagaaaaggaggggatgatcgaacaggtaactgattatgttattgataatgtcttccgtgatttgggcgcgtatctggcaacacataccgatcgctatgtttctattaacctgtcagcctccgattttcatacctcacggttgatagcgcgaaccaatcagaaaacagagcaacatgcggtgcgtccgcagcaaattaaatttgaagtgactgaacatgcatttcttgatgtcgacaaaatgacgccgattattctggctttccgcaaggccggttacgaagtggcaattgatgattttggtattggctactctaacttgcataaccttaaatcattgaatgtcgatattttgaaaatcgataaatcgtttgttgagacgctgaccacccacaaaaccagtcatttgattgcggaacacatcatcgagctggcgcacagcctggggttaaaaacgatcgctgaaggtgtcgaaactgaggcgcaggttaactggctgcgcaaacgcggcgtgcgctattgccagggatggttcttcgcgaaggcgatgccgccgcaggtgtttatgcaatggatggagcaattacccgcgcgggagttaacgcgcgggcaataaaactacaggcggtggcgataatcgctgggagtgcgatcaaactgccgacggaaaacgcgggagaaggtctgctgagagacataacccaggtccattgcgatatcaaaaatcggacgctcggtggtgcgcaactcaacggcggccagtaacagacggcgctggcgaatgtaatcgccaagcgtctgatgcgtcaccgtgcggaacatccgttgcaagtaccactttgaatagccagatttttttgcgacgacatcaatgttaagcggctggtcaatatgctcgtcaatccatgcgataagatcctgaataattttctgatgggacataaatctgcctcttttcagtgttcagttcgttaattcatctgttggggagtataattcctcaagttaacttgaggtaaagcgatttatggaaaagaaattaccccgcattaaagcgctgctaacccccggcgaagtggcgaaacgcagcggtgtggcggtatcggcgctgcatttctatgaaagcaaagggttgattaccagtatccgtaatagcggcaatcagcggcgatataaacgtgatgtgttgcgatatgtcgcaattatcaaaattgctcagcgtattggcattccgctcgcaaccattcgtgaagcgtttggcgtgttgccagaagggcatacgttaagtgcgaaagagtggaaacagctttcgtcccaatggcgagaagagttggatcggcgcattcataccttagtggcgctgcgtgacgaactggatggatgtattggttgtggctgcctttcgcgcagtgattgcccgttgcgtaacccgggcgaccgattaggagaagaaggtaccggcgcacgcttactggaagatgaacaaaactaaagcgccacaagggcgctttagtttgttttccggtctttgtctttctctctatcccgctggtacacaggagggtttcccccgacgtcaacacacctcattcgagcacgtggtggaggttccggttggtgttgatgctttaattgtatgttaccggcgtttcttcgccagtgtaaaagtacactttttagccgcaatatttttgtcatctcagacgattttttatcgcaatcctgaacggtatacggctcgataacgctgcaatcttgcgcatcgacgataacgtttgcgcatcaattgcctggtttttcatcgtcaagacaataaaagagaaaaaagcagcaaacttcggttgaaaaagccgctatgatcgccggataatcgtttgctttttttaccacccgttttgtatgcgcggagctaaacgtttgctttttttgcgacgcagcaaattgtcgcaaacctggagcaggaagataacgtttcgctggcaggggattgtccgccacgcatcttgacgaaaattaaactctcaggggatgttttcttatgtctacgccatcagcgcgtaccggcggttcactcgacgcctggtttaaaatttcacaacgtggaagcactgtccgtcaggaagtggttgccgggttaacaacgtttctggcgatggtctactcggttatcgtcgttccaggcatgctgggtaaagcgggcttcccgcctgcggcagttttcgttgcaacctgtctggttgccggactcggttctatcgtgatgggtctgtgggctaatctgccgttggcgattggttgcgccatctctctgacggcgtttaccgcattcagtctggtgctggggcaacatattagcgtacctgtcgcgctgggtgccgtgttcctgatgggtgtgctgtttacggtaatttctgccacgggtatccgtagctggattttgcgcaacttgccgcacggtgtggcgcacggcacggggattggtatcggtctgttcctgctgctgattgctgctaatggtgtcggtctggtgattaaaaacccacttgatggtctgcccgtcgcgctgggggatttcacgacctttccggtgatgatgtcgttggtggggctggcagtgattatcggcctggaaaaactgaaagtccctggtggcattctgctgaccattatcggtatctcaattgtcggtttgatcttcgatcctaacgtccatttctccggcgttttcgccatgccttcattgagcgatgaaaacggcaattcactgattggcagcctggacattatgggtgcgctgaatcctgtagtcctgccaagtgttctggcactggtgatgacggcagtatttgatgccaccggaactatccgtgccgtcgccggtcaggcgaacctgctggataaagatgggcagatcatcgacggcgggaaagcactgaccaccgactccatgagcagcgttttttctggcctcgtgggtgcagctccggcagcggtatacatcgagtctgcggcgggtacggcggcgggcggtaaaaccggtttgacggctatcaccgttggcgtgctgttcctgctgattctgttcctctctccgctctcttacctcgttccggggtacgcaacggctccggcgctgatgtacgttggcctgctgatgctgagcaacgtggcgaaaatcgactttgctgattttgttgatgcgatggcgggtctggttacggcggtattcatcgtgctgacctgtaacatcgtaacaggcatcatgattggcttcgcgactctggtgattggtcgtctggtttccggcgaatggcgcaagttgaacatcggtacggtcgttattgccgtggcgctggtgaccttctatgcgggtggctgggctatctaatcttacataggattctgaaaacgggtggcaatggctgcccgtttttattttctccgcacattgtgtgagcttttgcgatattctgaaaaaatgagaattcaggcataacgcctttctcagatcataaaaaacatcgcaaacagggaacgcatggaaatcttcttcaccatactgataatgaccctcgtggtctcgctgtccggggtggtcactcgtgtcatgccctttcagatcccgcttccgcttatgcaaatcgccatcggtgcgctactggcgtggccgacgtttggtttgcatgtggagtttgatcctgaactctttttagtcttgtttatcccgccgttgctgttcgctgatggctggaaaacgccgacccgtgaatttctcgaacatgggcgagagattttcggcctcgcgctggcgctggtggtggtcaccgtggtcggcattggcttccttatttactgggtggtgccgggcattccgctgatccccgcctttgcgctggctgcggtgctttctccgaccgatgctgtagcgctctccgggattgttggcgaggggcgcatcccgaaaaaaatcatgggcattttgcagggcgaagcgttgatgaatgacgcctccggcctggtgtcgttgaagtttgccgtggcagtggcgatggggacaatgatcttcaccgtcggcggtgcgacggtcgaatttatgaaagtggcaataggcggtattctcgccggttttgtggtgagctggctgtatggtcgctcgctgcgattcctcagccgctggggcggtgatgaacccgcgacgcagatcgttctgctgttcttgctgccattcgcttcttatctgattgcggaacatattggcgtttccggcatcctcgctgcggttgccgccgggatgaccatcacccgctccggtgtgatgcgccgtgcgccgctggcaatgcgcctgcgcgcaaacagcacctgggcgatgctggaatttgtctttaacggcatggtgttcctgctgttaggtctgcagttgccggggattctggagacgtcgctgatggcggcagaaatcgaccctaacgtcgaaatctggatgctgtttaccgatattattctgatatatgcggcgctgatgctggtccgtttcggctggctgtggacgatgaaaaagttcagcaaccgcttcctgaagaagaagccgatggagtttggttcgtggactacacgagaaatcctgatcgcgtctttcgccggggtgcgtggggcgatcactctggccggtgtgctctctatcccgcttctcttgccggatggtaacgtcttccctgcgcgctatgagttggtgttcctagcggctggcgtcattctcttctcattgtttgtcggcgtggtgatgttgcctattctgctacaacacatagaagtcgcggaccattcgcaacaattgaaagaggaacgtattgcacgagcggcaacggcagaagtggcgattgtggcgatccagaaaatggaggagcgtctggcggcggataccgaagagaatatcgataaccagctgctcacagaggttagttctcgcgtcattggtaacctgcgtcgtcgcgccgatggacgtaatgatgtagaaagttcaatcctggaagagaacctggagcgtcgcttccgtctggcggcattgcgttctgaacgtgctgaactgtaccacctgcgcgccacgcgggagatcagtaacgaaacgctgcaaaaattactgcacgatctcgatttgcttgaagcgttgctgattgaggaaaatcagtaatctgcatggttggcgggcgannnnncattccattcattaattaattaatgaatgaatgnnnnntcctaatttccagcttagttcgctttccagcggtagccattttaaggtgtttttatctaatcgctggcaaatgggttccggcaatatggctattccgacaccggcctgaaccatcgcggcgagaaaatcccattgcccgctgcgaactgcaattctcggcttaacgccatgttcatcgaataacttcatcaattgcttacttaaggcaaaatcttcgttatagataagtagaggatgttccgccaatgtctccggtgagacggcatcacattcaagccatttacctgaatgtggcgtcagtacacatagtggatgactaaacagcgataacgttgtcaggccgctttcttctactggcagggctgtcagtgccatatccagttcaccgttcatcaccgcttgttgtaccgtcagaccaccaaactccgaaattttcaattctacgccggggtaacgctggcgaaaaaggccaatcggcccggccatcaacatcccaaccatcggcgggattcccagccgcaaaacgccggttttaagctgattgatatcgctaagctcagcttccagttgccgaaactcagccagtaaagccagcccgcgctcaaatacgacgcgaccagtatcagtgagaagcagccgacgaccatcgcggatcaacaatatacagttcagctcatcttcgagattcttcagcatcttgctgatagttggttgggtgacaaacaacttctccgctgcgcgggtgaagctttgctggcgcacgacttcgacaaaataacgcagcgttctgatatccataactattccctttgactatacctgcaatgattttaattcatttcagtcaggggcgagcgctctctatacttaccattctgttttattttcaggatatcctctcatgcccgtggcgcttcgccgcattacccctgccgtagtgcaatctatccaggtattttttcaggttgtgctgtatgcaggtttatttatttttgcgcagtatctcgtctcctggctgcatttgccgctgcctgccaacctggtggggatgatcctgatgctggcgctgattgtttgtcgcattcttcctctgcaatgggttcgagccggggcgcgttggctattggccgaaatgttgctgttttttgtccctgccgtggtggctgtggtgaactatgcacaactattactggtggatggctggcgtatttttgctgtgatcgcgctgagtacggtgatggtgctgggcacgactgcctgggtagtggaaaaagtctatcgctatgaaatgcgcaggttaaaccgtggctaattttcagctaagtatgctctgtctggcaattacgctagttatctattttcttaacaaacgcctttatcgccgctttcgtaaattgccattgatgcctctggtgctgacgcctacgctactggttatgctgctggtttttggcaatatttcctggcaaaactatattggcgaagcgcacgggttactatggctattaggtccggccaccatcgcctttgcggtaccagtgtatgacaatcgggcgatcattaagcgtcactggatgtcgttgacggcaggcgtactgacggcaacggtggtggcagtgaccagctcagtgtggctggcgcgattgtttaccctgccagatgagatccagcgtagcctggcggtgcgttcggtcactacgccatttgctttggcagcgagccagtcgctcggcggacagcctgatctggtggcgctgtttgtggtggtcaccggtgtgtttggcatggcgattggcgacgtgttgtttttacgtctctctattcgcgaagggatggcgaaaggtgctggattcggcgcggcatctcatggtgccgggactgcgcggtcatatgaactgggtcaacaagaaggcgtagttgcaagcctggtcatgatgctttcaggtgtattgatggtattggtttcgccgctggtggccaggatgatgttctgaagaaattccccgatcaagcgaccggggaaggggagagattaatgcgcgcggccctgctcaacgccaaagccagtctgggaacggataaactgcgcacggaacagttcacgctcgcgcgcaccttccgctgaattatccgttgccgagaataaccagataccgaggaatgccacgctgatagagaacagcgccgggtattcatacgggaagatggctttttcgtgaccgaggatctgtacccaaatagtcgggccgaggatcatcagcaccaccgcagtaatcagtcctaaccagccgcccagcattgcgccacgggtagtcagtttcgaccagtacatggaaagcagaatgatcgggaagttacagctcgccgcgatggcaaacgccagccccaccataaaggcgatgttctgattctcaaacagcacgccgaggataatggcaatcacaccgaggatcagtacggtgattttcgatacccgcagctcttcacgttcggtcgcaccttttttgaagacgttagcgtacaggtcgtgagacaccgccgatgcgcccgccagcgtcagacccgcaaccaccgcaagaatggtggcgaaagcaaccgctgaaataaagccgaggaacaggttgccgcccaccgcattggccaggtgaactgctgccatgttgttaccaccaatcagatggcccgccgcgtctttatattccggattcgcaccgaccagcatgatcgcgccaaagccgataataaaggtcaggatgtagaagtagcccataaatccggtggcgtagaacacgctcttacgtgcttcgcgggcatcgctgaccgtaaagaagcgcatcagaatatgcggcaagcccgccgtaccaaacatcagtcctagccccaaagagagcgcggagataggatctttcaccagcccgcccggcttcatgatgtcgacacctttcgggtgtaccgccatcgcttcgctgaacagattgttgaagctaaagccgacgtgtttcatcaccataaaggccataaagctggcaccgaacagcaacagcacggctttaataatttgtacccaggtggtcgccagcatgccgccgaacaggacgtacatcatcatcagcacgccgaccagcactaccgcaatgtgatagttaaggccaaacagcagctcgatcagtttacctgcgcccaccatctgggcgataaggtaaagcgccaccaccaccagagaaccacaggctgaaagaatacgaatcggcccttgtttcagacggtaagaggccacatcggcaaaggtgtagcgaccgaggttacgcagacgttcggcgatcaggaacaaaatgatcggccagcctaccaggaagcctagcgagtaaattaagccgtcatagccggaggtaaacaccagcgcggagatccccaagaatgaggcggcggacatatagtccccggcaatcgccagcccgttctgaaaaccggtgatattgccgcctgcggtgtagtagtcattacgcgaacgtacgcgttttgacgcccagtaggtaatgccgagcgtaaacacgacgaaaatcaggaacataataatcgcctgccagttcgttggctgacgctctacggccccgctaatagcatccgcggcgttagctgcgaaagggagtgtggcggcaagcgccgtcagaactcttttcatgatgcttgtacctcatgcaggacttcgttattaagacggtcgaattcgccgttcgcccgccagatgtagataccagtgagaacaaaggagatcacaattaccccgacaccgactggaataccgcgtgtgacgctggtgttcggattcagcggggtgcccagccagccgggcgcgaaggcgatcagtaaaataaagccgatataaactgccagcataataatcgacaggatggtggcaaaccgttgccgtttttcgactaactccctgaaatgcgcattgtcttctatccgctgataaatcgtaccattcatcacagattctccagaggtaatgtagggattgttttaattcccgctcccttatgggagaaggttaacgcttgggtaacccttgccgaatgtaggccggataaggcgttatacgccgcatccggcaatcaatgcctgatgcgacgctgtcgcgtcttatcaggcctacagccgttgccgaatgtaggccggataaggcgttcacgccgcatccggcaaccagcgcctgatgcgccgctgtcgcgtcttatcaggcctacaaaccgttaccgactcgcatccggcaattgtgggttacgatggcatcgcgatggcctgcttctcttcaagcagcttctcgactacgccaggatcggcaagcgtcgaggtatcgcccaggttgctggtatcgcccgccgcaattttgcgcagaatacggcgcataattttgccggagcgggttttaggcagggagtcggtccagtgcagcacgtctggcgtcgccagcgggccaatctctttacgcacccagttgcggacttctgcgtacagttctggtgacggttcctccccgtgattaagcgtgacgtaggcgtagatcgcctgacctttaatattgtgcggaataccgaccacagcggcttcggcaattttcggatgcgccaccagcgccgactcaatctctgccgtccccaggcggtgaccggagacgttcagcacgtcgtccacgcgcccggtgatccagtaatagccatcttcatcgcgacgcgcgccgtcgccgctgaaatacatatttttgaaggtggagaagtaggtctgctcaaaacgttcgtgatcgccaaacagagtacgcgcctgacccggccaggagtcggtgatcaccagactgccttcggtggccccctccagcgggttaccttcgttatcgaccagcgctggttgcacgccgaagaacggacgtgttgccgaaccggctttcagctcggtagcgccaggcagtggcgtgatcatgaaaccgccagtttcggtctgccaccaggtgtcgaccaccgggcatttctcattgccgatcttcttccagtaccactcccacgcttccgggttaattggctcgcccacggaaccgagaatgcgcagcgacgaacggtcggtgccttcgatcgctttatcgccttccgccatcagcgcgcgaatcgccgtgggcgcggtatagagaatattgacctgatgcttgtccaccacctgcgccatacgggcaggcgtcggccagttcggtacgccttcaaacatcagcgtggtcgcgccgcaggccagcgggccatacagcaaataactgtgtccggtaacccagcccacatcggcggtgcaccagtagatgtcgcccggatgataatcaaagacatatttaaaggtcagcgccgcgtacaccagataaccgccggtagtgtgcagcacgccttttggcttaccggtagaaccggaggtatagagaataaacagcggatcttcggcgttcatctcttccgcctggtgctgatcgctggcttgctcaaccaggtcgtgccaccacaggtcgcgcccttcctgccagtcaatttttccgccagtacgcttcagtaccaccacatgctctacgctggtgacgttcgggtttttcagcgcgtcatcaacgtttttcttcagcggaatactacgcccggcacgcacaccttcgtcggaagtgatcaccagtcgtgaactggagtcgataatgcgtccggcaacggcttccggcgagaagccgccgaaaatcaccgaatgtaccgcgccaatgcgggcgcaggccagcatcgcgaccgcggcttccggtaccatcggcatataaatcgcaactacgtcaccttttttaatgcccagttcgagcagggtattggcgaagcggcagacgtcgcggtgcagctctttatagctaatatgtttgctctggctggcgtcgtcgccttcccagatgatggcggtacgatcgccgttttcttgcagatggcggtcaaggcagtttgccgccagattcagcgtgccgtcctcgtaccatttaatggacacattaccgggggcaaaggaggtgtttttcaccttctggtacggtgtgatccagtcgagaatttttccctgttcgccccagaaggtatctggtgcgttaatagattgttgatacatcgcctcgtactgctgagggtttatcaggcaacggtctgcgatgttggcaggaatggtgtgtttgtgaatttgactcatgcttttgttctccttgtaagatgttaataatatgtggcataagcgttaaatgtaggggtattggcagttttgtttagtatttgggcgacagatcacgcaaaagtagaattgtgcaaataaacggcagggtaatttttgaaggtcagcaacaaaagttgattaattctttgaggaacatgcagttatgcatgctgttgaaaaagaggaagatactgactaactctaaagtggtattttacatgcacttacaattgattaaagacaacattcatagtgtggttatttgttacacatagggacgagcaatgtcatgacagtgtaggtgcggttactgtcgtgaaaaacaataaaaaccgccattgcaacaatggcgcaattcggatgaagccctatgacaaggataaaaataaacgcacgccgtatcttcagcttattgattccttttttctttttcacttctgttcacgctgaacaaacggctgctcccgcaacacctgtaactgtggaagcgaagaatgaaacctttgccccgcagcatcccgatcaatatctctcctggaaagctacctcggaacagtcagagcgtgttgacgccctggcggaagatccacggctggtgatcctgtgggcagggtatcccttctcgcgcgattacaacaagccgcgtggacatgcctttgctgtgaccgatgtgcgtgaaaccctgcgtaccggtgcgccgaaaaacgctgaagatggtccgctaccgatggcgtgctggagttgtaaaagcccggatgtggcgcgtctgatccagaaagacggcgaagatggctacttccacggaaaatgggcgcgcggcggcccggaaatcgtcaacaacttaggttgtgccgattgccataacaccgcctcaccagagttcgccaaaggcaaaccggagttaaccctttcccgtccgtatgcggctcgcgcgatggaagccattggtaaacctttcgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggcaaaaacaacgtgacctgtatcgattgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcggcactggatgcaggcgcaacggaagccgaaatgaagccgattcaggacgatatccgtcatgcccagtggcgttgggatttggcgatcgcttcccacggcattcatatgcacgcaccggaagaaggtctgaggatgctcggtacggcgatggataaagcggcggatgcacgcaccaaactggcgcgcctgctggcgaccaaaggcataacccatgaaatccagatcccggatatctcgaccaaagagaaagcccagcaggccattggcctgaacatggagcaaatcaaggccgagaagcaggacttcatcaaaacggtgatcccgcagtgggaagagcaggcacgtaaaaacggtctgttaagccaataaccccgttccgcctcgcaaggggcggaaaacacaatggagtgaatatgagcgtattacgttcgttattaactgccggggtgctggcgtcgggcctgttgtggagcctgaacggaattaccgctacccctgcggcgcaggcatctggtgatcgctacgaagttacccagcagcgtaacccggatgccgcctgtctggactgtcataagccagataccgaaggtatgcatggcaaacatgcttccgttatcaacccgaataacaaactgccggtcacctgcaccaactgccacggtcagccatcaccgcaacaccgcgaaggggtgaaagatgtgatgcgctttaacgagccgatgtacaaggttggagagcagaacagcgtctgtatgtcctgccatctgccggaacagttgcaaaaagcgttctggccgcacgatgtccacgtaaccaaagtggcgtgcgccagctgccattccctgcatccacagcaagatacgatgcagacgttaagtgacaaaggacggattaagatttgcgtcgattgccacagcgatcaacgcaccaatccgaactttaacccggcgtctgttccgttgcttaaggagcagccatgacctggtcacgtcgccagtttctcaccggcgtcggtgtgctggccgccgtcagcggcaccgcaggacgcgtggtggcgaaaacgttgaatatcaatggtgtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgatgtctgcccgaccggtgcgtcttttcgcgacgctgccagtgggattgtcgatgttaatccggatctctgcgtcggttgtcagtactgcatcgccgcctgtccgtaccgcgtgcgctttatccatccggtcacgaagacggcggacaaatgcgatttctgccgtaagacccatttgcaggccggtaagctgcccgcgtgcgttgaggcttgcccgacgaaggcgctgacgtttggcaatctggacgatcccagcagtgagatttcgcaactgctgcgccagaagcccacttaccgctacaagctggcgctgggaaccaaaccgaagctgtaccgcgtaccgtttaaatacggggaggtgagccaatgacgcagacttccgcatttcattttgaatcgctggtgtgggactggccgattgccatctacctgtttttgattggtatttctgccggtctggtgacgctggccgtactgttacgtcgtgtctacccgcaggcgggcggtgcagacagtacgttgctgcgcaccacgctgattgtcgggcctggcgcggtgatcctcggtctgttgatcctcgtcttccacctgacaagaccgtggaccttctggaagctgatgttccactacagttttacctcggtgatgtcgatgggggtgatgctgtttcagctttacatggtggtgctggtgctgtggctggcgaaaatctttgaacatgatttgcttgccctgcaacaacgctggttgccgaagctggggatcgtgcaaaaggtcttgagcctgctgacgcccgttcatcgcggactggaaacattgatgctggtgctggcggtgttgttgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcactttgtacaccgtatggaaatccccgtggtatggggtgaaatcttcctgctggtggcgttttttgtcggtctggcgctgggcgatgacggtaaagtgcgtgcgctggtggcggcattgggcggcggtttctggacatggtggttctggcttggtgtcgccgggctggggctgattgtgccaatgttgctcaaaccgtgggtcaatcgcagttccggcattcctgccgtgctggctgcgtgtggggccagcctagtcggcgtgttgatgctgcgctttttcattctctacgccgggcagttgacggtggcgtaagccagaacagaggtggtttctggacgtattccttcctgaagtcggttttctggcgttgttgttaagtctcggggtcaacgtgttgaccccgttgacggccttcgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcccaacatagctatagcctgctgtcgtgggaactcaaactggcggcggtgtggggcggtcatgaaggttcgctgctgctttgggtgctgctgctttccgcctggagcgtgctgtttgcctggcattatcgacagcaaaccgatccgctatttccgctcacgttaacggttttatcgctgatacttgccgcactgctgctgtttgttgtcggatggtccgatccttttgtgaggatatttccgcccgcaatagaagggcgcgatctcaatccgatgctgcaacatcccggtcttatctttcatccaccgctgctttatctcggctacggcggtttgatggtggcggcgagcgtggcgctggcgagtttactgcgcggcgagtttggtggtacctgcgcccgaatttgctggcgttgggcactacctggctggagcgcattaacagcggggatcatcctcggttcctggtgggcctattgcgaactgggctggggcggctggtggttctgggatccggtggaaaacgcgtcgttattaccctggctttctgccacagcgctgctgcacagtttatccctgacacgccagcgggggattttccgccactggtcgctgttgctggcgatagtaactctgatgctgtcgctgctgggcaccttaattgtccgttctggcattctggtttcggttcatgcgttcgcgctggataacgtccgcgccgtgccgttgttcagcctgtttgcactgattagccttgcgtctctggctctgtatggctggcgagcgcgggacggtggcccggcggtgcgtttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttgctctgttgatgctggtggtgattgtgctggcgacgtttgtctctggcaaacgtgctcagcttccggcgctgctggcgcatgcgggcgtgctgttatttgccgcggggatcgtggtttccagcgtcagccgtcaggagatcagcctgaatttacagccgggtcagcaggtgacgctggcaggatacaccttccgttttgagcgcctcgatctgcaagccaaaggcaattacaccagtgaaaaagcgatagtggcactgtttgaccatcagcaacgcattggtgaattaacgccggagcggcgtttttacgaagcacgtcgtcagcaaatgatggaaccgtcaattcgctggaatggcatccatgactggtatgcggtcatgggcgagaaaaccggagcggatcgttacgcttttcgtttgtatgtacaaagcggtgtgcgctggatctggggggaggattgttgatgattgcgggcgcattgttaagcggatggcggggaaggaagcgcgatgaataaagggcttctcacgctactgctgttatttacctgttttgcgcgcgctcaggttgtagacacctggcaattcgccaatccgcaacaacagcaacaggcgttaaatattgccagccagttacgttgtccgcagtgccagaatcagaacttactggaatccaatgcgccggtggcagtcagtatgcgccatcaggtttacaccatggtggaagaggggaaaagtgaagtcgaaatcattgactggatgaccgaacgctacggagattttgttcgctataacccaccgttaacgggtcagacgctggtgttgtgggcgctgccagtagtgttgttactgctgatggcactgatcctctggcgagtgagggcgaagcgatgaaacagccccaaataccggtgaaaatgctgacaacactcacgattttgatggtatttctctgtgtcggcagttatctgttaagtccaaaatggcaggctgtacgtacggagtatcagcgtcagcgcgatccgctgcatcagtttgccagccagcaaaccccggaagcgcagcttcaggcattgcaggataaaatccgtgctaatccacaaaacagcgaacagtgggcgttactgggcgagtattatctgtggcaaaacgattacagcaattcgctgctggcgtaccgtcaggcgttgcaactacgtggtgagaacgctgaactgtatgcggcgctggcgacggtgctgtattaccaggccagccaacatatgaccgtccagactcgcgcaatgatcgacagagccctcgcgctggactctaacgaaatcaccgctctgatgctgctggcttccgatgcgtttatgcaggcgaactacgcgcaagccatcgaactatggcaaaaagtgatggatctcaactcaccccggatcaaccggacacagctggtcgagtcgattaatatggcgaaattgttgcagcggagatcagattaatcatctggtgatgaagattatgttattgagctgcataaaaaataatcgaatgaacatataatcaaaaataatcaccaatcagtattattgcagattaaacaaataaaaatccttctataacaaatggttattcattaatcctgccataaactcgcgttattatgcattaatgcagcgaaaagctctgttgttaaagggttgcgcaacataccgcgcaaatgatactgatcataagcgttaaaaaaatctacaaaccaacgcaacacaattcatgccctggcagtatgtcacgttctcgcgtttctgaacggggaacggcgctccattgaggaagttattctgatgaaaaatataaaattcagcctggcctggcagattctgtttgctatggtgctgggcattctcctgggaagctacctgcaccaccatagcgacagccgcgactggctggtcgtcaatttgctctctccggcgggtgatatcttcatccatctgatcaaaatgattgttgtgccgattgtgatctccacactggtggtgggtatcgcgggtgttggtgatgccaaacagctcgggcgtattggtgcgaaaaccattatctacttcgaggtgatcaccaccgtcgccatcattttggggatcactctggcgaacgtcttccagcccggtgccggggtggatatgtcgcagctggcgaccgtcgatatctcgaaatatcagagcactacggaagcggtacaaagcagttcccacggcattatgggcacgattttgtcgctggtgccgacgaacatcgtggcgtcgatggcgaaaggcgaaatgctgccgatcatcttcttctcggtgctgtttggtctggggctttcatccctgcccgcgacgcatcgtgaaccgctggtgacagttttccgctccatctctgaaaccatgtttaaagtgactcacatggtgatgcgttatgcgccggtgggtgtgtttgcgctgattgcggtgacggtggctaactttggtttctcgtctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtgctgccgcgaattattgagaagatggaagcctacggagcaccggcgtcgatcaccagtttcgtggtgccgaccggttactcttttaaccttgatggttcgacgctgtatcaaagtattgccgctattttcatcgctcagctgtatggcattgacctgtccatctggcaggaaatcattctggtgctgacgctgatggtgacctcgaaagggattgctggcgtgccgggcgtgtcgtttgtggtgttgctggcaacgctgggcagcgtagggatcccgctggaaggtctggcgtttattgccggtgttgaccgtatcctcgacatggcgcgtactgcgctgaacgtggtgggtaatgcgctggcggtgctggtgattgccaaatgggaacacaaatttgaccgtaagaaagcgctggcttatgagcgtgaagtactgggcaaatttgataaaactgcggatcagtaattgaagattgccggggggatatccacccggcaatgtgtggatgcctgactgagtaatagcctgatgtagcgtgatttttgtaggtcggataaggcgtttacgccgcatccgacatcaatgcctgatgcgacgtttgctgcgcctaccttaaccgttagttaatttttcaaactcttcacaaccggtatcaaatccttccatacagctcagattcaaccagtgcagcgccttttgtttattcttctcgataaaaccctcttcaccgtttaagaacatcattcccgcccagtattcggaataaccggttcgggaaatcgcggagctacgcttgaaataccaggttgctttgtcatcgtcggccttaatgcccacgccgttggcgtaaatcaaaccaagcagcatttgggcatcgacggcagagtcgttctccagatcttccgaggcgttttctaacagcgaaatcgcctttggataatccggtttacccgcttgcgtatttaccagaatatgcgccagcgttacttcaccttctttactgcccgcttgcgctgctttctcggcaagcacttttgcttgtggatagtccagactgaccggattggtgattttgatctgcgccaacagcgcacaggcatcggcatcaccgctgtcggcggctttctgtgcccaatattcggctttgctcaaatcgccggagctaaaccagctgtcggcaagaaaatattgtgcgcgtcggtctccggcctctgctgcctttaaatactggctgccaggctcggagtcgttcgcgtgggcaaagaatgtcaaaaacaacatcaaagtgataatttttttcattttgataatgaagtttggtaggggagagacagtataaagtgttcgggtggacaaaaaaacaactgtaaaaagacctgaaagcagaatgaattaatgcaatgtcaggttttttaatccatccgatgttcccccttttccatggcgtcgcgatcaaaaaatcgctgaatttttccctcggacatcaatgccgctcgatcagacatatgcgcgatgacatcggcatcgtgactgaccagcagatatgtcatttggtgttccagcttaagttgattcaacaaattaaggatttccgcttgtaccgacatatccaacgccgaggtgggttcatccagcagaagaagttgtggtcgtaacaacagggcgcgagcaataaccacacgttgccgttgaccaccggaaagctggtgtgggtagcgacgagcggcgtcgaaaggcaagccaacctgttccagtgcagtctggacgcgtttttctatttctctttcgccacgaattttgagtggttcagccagcgttcgccacagagtatgattgggatgcaacgaggcatagggatcctgaaacaccatttgcacattgcggcggagatcgccttgaaaacgcattcctggtttgatggtgtgcccaaacagtgacacctgaccgtgccagtcgcgctgtaatccagcaattacgcgcaaaatcgtggattttccgcagcttgattcgccaattaaactaaatgtctctccggcattaaccgaaaaactggcggcagaaactgcggttttctcagcaaaagtcacctgtaagtgattaatttcaacaatcgtcatggtatttctccggcgtcattgccgtcctgtccagcgtcggcagcatctgcccgtaagtttgtgcatttgggcggcaagtccacagtgtgcgcgtgtaaggatgcgttgctgtaggtagcgcagcagcgtgcatttcatccaccttatttccctgatacatcaccagcacccgatggcaaaattgggcaactaatggcaggtcgtgactgatcagcaacattgccatctgacgttgttcacactgggtaaccagcagttccagaatctgattacgcaggcgcacatccagtgctgatgttggctcatcggcaatcaatacccggggatcgttgatgagcgcaattgcaatcatcactcgctgccccatgccgccagaaagttcacgaggatagctttgcagtactcgcgtattgaggccgacagcctgaattgcggtgtttattttctcttctttctcgcggcggttcagacgttgatggagcgtaagcgcctcttccagttgcgcttttactgtctttactggattaagcgcgtaacgcggatcttgcaataccatcgcgatatcgttaccgcgcaactgttgccatccacgcgcgttaagggtgagtgcatcacgccccagaatgttaagtgtgtccgcggttactacacccggtttacgcaccagccccatcagggcgcgggcggtcatggacttacctgaacccgactcaccgaccagcgccagacgttcattgcctaatgtaaaactgacattgttgacgacccgggactccggataatcgacgcagagattgttgatactaagacgtgagtcagtcatgttgaggctccagaacatcgcgcaagccatcacccagcagattaaaggccagactggcaattaagataattgcgccgggagcggcggcaatccaccattgatcaaaaatgacctgcataccgtcggcgatcatggctccccattccgccattggcgggcgagcaccaagcccaagaaaacccaggccagcagccgccagaatgatacccgctaaatccagtgccagacggacaatggcagatggcaggcacaatggtaaaatatgaccagccagcagacgcctgccgcggatgcccatcatttctgcggcggcaagataatcactgtgtcgcagacgttggatctcactccgtgcctgacgcgcataagcaggccaggtggttaatgccagggccagtgcgccgttaaccagccccggccccagcatggcaacaaaagcaaaagccagaattaaacgcggcattgacattactacgtcagtaaaacgcatcagcacgcgttccagccagccgccgtagtacccggctaaaatgccaatcagcagaccgaccgggagtgtaatgattgtcaccaatgccaccagccccagtgccgggcggctgccgtagattaaacgtgaaagtaggtctcgtccgtaactgtcagtgccgagccagtgctgacgactcggtgcttgtaaccgcgccgccgcatcctgccagttaggatcgtgaggtgccagccacggcgcgaagagcgcaattagcattaataacaggataattatcaacccgcaaaacgcggcgggtgaatggcgtaaacggcgtaaaaagagaaacatcggcatcagcgtaacctcggatcggtcagccggaccagcaggtcggttaagttatttatcaacacaaagcagacgccaatcagcagcgttcctcccatgattgctgtggtatcacccgcgaagagcgctgtagtgaggtagcgcccaatacctggccatgaaaagacggtttctgtcagtaccgcgccttccagcattgatgtataggcgagggcgataacggtgagcaaggtgccgcgaatgttgggtaaaacatgacgtagcaaaattgtcatctcgctggcccctttggcgcgcgccagcagaatatattctttattcatttcgccaagacaggcggaacgagtcaggcgcgtaatactggcgagcgagaagtacgccagtaataaaaccggaagtatcaaatggttgattgcattggtaaatgcctcgcgatcgccagaaagccacgtatcaatcagcgcaaatccgctgcggggttctatggtgaattgataaatatcatccagcctgcccggcccggcactccattgcagtctggcgtagaacagcgccagcatcagcagaccaagccaaaaaacagggacggaatttcccagtagagttaatgttcgcacggtgaaatccagcggagaaccgacataacgggcgcaaagtacacccgcaatgacgccgacaacagcaccgacaataagcgccaacgttgccagttcaatggtcgccgggaatactgatagcaagtcctggagtaccggttgcccggtggagctggcgatgcccagatcgccgtgtgccagattcatcaggtaatgccagaactggacggctaacggctgatccaatcctaactggtggcgtacctgatcataggtggactggctggcgtgatcgccaacgatttgtagtacgcgatcgaccggtgagagagccgaaagcgcaaaggtaatcagcagcaggccgagtagcgtcagagcaacggtaaacagcccttgcaacagcgcgagcagagggcgcttgcctcgccatctcgcgcgagtggaaaaaacgacagacatgatctttccatacagtgataaatcagcggctggcctgcaatacaggccagccctggtaccgcgcccggtaacagggctggacgcgagttgcatacagggttatttggttacctgatcaaaccagaccatatcggcattcaacccttgttgatacccctgcacattatcacgcatgacaatttgcgttttgccttgatcaataaagacatacggggaactacgttgtagttcttgttgcattttcttatacaaatcaagacgtttagtgctatcaggttcagcgatggccgccagcgtttctttgttcagttccgggattttccagccgtttaacccggcaacggtgctggatttgccatcgttataggcgaaagagctggcgttggaatgtgcgtcaaaataatcaggcaaccacatacgaatggccccctgatgctggtgggcgcgaacgcgagagtagacctgactccctgcggctggcagcaaatcaacttttacaccgccctgagcaaagctggcctgaattgactgcgcgatggtaataaatggcggtttattttcgacatcaagcgtgaagtgcgggtctttgattccggctttagcgaggatctcttttgctttggctggattaaaggtaaacggtgtttcttccagtgctccaggaaagcccacgggcaggaaactttgatgggtaaaatattgtccttttaagagatttttggtgatgccgtcgtaatcgaccaaccagcgagcggcctcccagaacgcaggattactcatcagcgggttatccttgttaccggtattgaaggccaggtagttctgttcggcggaggcaatgctcatcacttttacgccaggtttaccctgtaatgcatcgatttgatcggctcccagatcacgagccatatcagcatcaccttgttggatcagcaggcgacgcgttgccggatcgggaacatttttgatgatgacgtttttcagtttcggggcgccggttggtgagctggcgttggcttccatcacgatggcctgatgcggttggtaagtacgcattttaaacgcgccgctgccagcggaatgcatcttcagccattcattaccaaagtcgttatttttggcgtttggcgcaaccagcttctcgtcaacaattgaggcgattggtgtggagagaatattcagtgccagcgccgggctgacgtcggcactccattgcacctggacggtatggtcatcgattttcttcaactggctggcgatattttccggctgccatcccagcacattgagaataaacgcaccggatttattcagtgtgacagcccggacataagagtaaatcacatcttccgggcgtaccggattaccagaggcaaatttcgcatcgcttttcagttttatggttagcgttttggctgcggggtcagcctgccaactttccgccagaatcggagtgattttcgtcggatcattacggtccggttgtactacgcgttgatacagacttggtacagtctgaatacttgagagttcattagcttctgccgggtccagactcacaatatcatccagtccctgggctacaaccaacgtattaggcggtgtagcggcaacggttgtggcggaaattgtgcttaaaaccagtaaaggtaatagttttttaatcatatgcttcccaatccctgaaattactttgaggttattaatatgctatcagacggggtttcgctgcattaatcgcgccagaatatcccgttaatagaacgagttaaacggtcgatgatttctcaccttaccgaaattttgtttatcaaatgtaaagtattattacgttaggccgcgatgagaattgagtaaagataattctcatttgcaatcgtgactggaatagaagaacaaccgagaagacgtcgctaataaccaggatgggctggtttgactgcgcaggtatgtataaaaaaatccggaaacagagagtcgtttccggattgatacaaaggcgttgggtaatatcgccgcttttaacgtgagtttacgcggtattacgccagtgccgcttcgcgcaggcgagttttcaacttgttgtactcgtcaatcacgtactgctcggcggcgcgctgatcggcgatcggctcgacgcgcacggcgcagtatttgtattccggcgttttcgtaatcgggcttaagttttcggtcaccagctcgttacaggcaccaatccaccactggtaggtcatgtaaatcgcccctttgttcggacgatcgctgacctgcgcacgggtgataattttgcctttacgcgagtgcacccaaaccaatgcctcatcttcaatacccagacgtttggcgtcttcggtattgatttgtgcgtagccaggttcatcagccagcgccgccagtgccgcacagttaccggtcatcgaacggcaagagtagtgaccaacttcacgcaccgttgacagtaccatcgggtactcgtcggtgagtttgtcgattggcgctacccagtcgcaggtgaagaactgcgccagaccgttcggggtatcaaacttctctttaaacagataagaagtcccctgatcggcatctgaagtatcgcggcaaggccactgaatgaagcccagttcgcccattttctcgtaagtcgcaccgtagaaatccgggcacagatgacgcaactcgtcccagatctcctgggtgttgttgtagtgcatcggataacccatacgagtggcaatttcactgatgatttgccagtccgttttcagatcccacttcggctcaaccgccttgaagaaacgctggaagccacggtcagccgcagtaaacacgccttcatgctcgccccacgacgttgacggtaaaatgacatccgccgccgacgcggttttggtcataaagatgtcctgaacgataaccagttccagatcttcaaaggctttacgtactgccgacagttccgcgtcagtttgcagcggatcttcgcccataatgtacgccgctctcacttcaccatgcgccacgcggtgcggcagctcgctgatacgataaccggtatgagcaggcaggctttccacgccccaggctttggcaaatttctcgcggttagccggatctttcacgtactgatagcctggatacgtatccggcagcgcgcccatatcgcaggcaccctgcacgttgttctgaccacgaaccgggtttacacccgcatgtggcttaccgaggttaccggtcagcatcgcgaggctggtcagagaacgcacggtttccacgccctgatagaactgggttacccccatgccccacaggatggcggcgctttccgcctgggcatacatccgcgccgcctgacgaatctcactggcgctgacgccggtgatatcttcaaccgactccggcgtgtagccttcaacgattttacgatactcttcaaagccttctgtacgggaagcgacgaacgctttgtcgtacagattttcttcaataatgacatggcccatcgcattcaacagcgcgatgttcgagccgtttttcaatgcaatgtgcatgtcagcaatgcgcgcggtttcaattttacgcggatcgcagacgataattttcgccccgttacgtttagcgttaattacgtgattcgccacgattgggtgggaatccgccgggttatacccgaaaacgaacactaaatcggtattatcaatttcgttaatagcattgctcattgcgccattaccgaccgattggtgcagacctgcaaccgatgggccgtgtcagacacgagcgcagcagtcaacgttattggtaccaataacggcgcgcgcaaatttttgcattacatagttggtttcgttacccgtaccgcgcgaggagccggtcgtctggatggcatccggaccgtacttctctttgatggcgctcaggcgctcggcaacgtaattcagtgcctcatcccaggaaacaggttcgagtttgccgccacgctggcgacggatcatgggggttttcaggcgcggggtcaggatctgggtatcgttaatgaagtcccagccataataacccttcagacacagggtaccctggttggttttcccctgcgctgcctccgcccggacgattttgccgttatcgacgaccaggttgattttgcaacctgatgcgcaataggggcaaaccgtgacgacttttttcatcggtctcgctccagttaatcaaatcacgcatacgcgctctcgactacagtatgcatcttttatgccacattttatttggggtcattccctgatattacgggcactatttattcaaaactctgacgaaaaacaggctgtcgtcagttttgacgtgacgaaacgaaataccgcgtgacagccatcacgcggtagacattttattttttctcgacgatgggagccgcctgatacccgccgcccagcgatttcatcaactgaatgctttggatcacccggcggctgtccagcatcagtaatgacatctcttcggcaagcactggcaaccgggcttcggtggcctgtaagcggctggttaagccgcgctgataggcggcctcggctgcgcgctgggtgaagcgcgttgcttctacgcgttcagcctgcatctctcgctcgtcgttgagcgtttgcagacgtgtgccgttgacggcaacgtcacgcaccgcgttcagtactgactggttgtaacgttcaatcatcatgttgctggcggcgcgagtgccttcgagattggcattcaaccgtccaccgtcaaacagcggcaatttcagacccgggatgaagttgaactggcgactggtttttttgaataaggtatccaggtggatggagtccagaccgaaaaacgctttgatatcaaagctcgggtagaacagcgcccgcgcggaatccacctgatctaatgacgcctgaacataccagcgcatggcttgcagatccgggcgtctggcgagcaactcataagagagcgttgccggaatgccggtctgtactcgtggtaatgccaccggtttgatctccggcatatcgctggctcccgcgccaatcaatgcacgcagagattctcgcgtttcagtgatttgccctttgacggcagcaatttgtttatcgaccgccagaatctgtgcccgcgcgccgtggaaaggcacttgcgcttccagaccgtgcgccactttactctggtgcgctttcaccgcgtaatcaatcacatcgcgagtttgttctaacagatcgagcatctgatagctggcctgcatactgtaataaagctgcgctacgcccgtggtcagcgatagctctactgctgcggtttctgccagcgcggcattatgcgcgccaatggcggcagcaaccgctgagcgatgcacaccccacaaatcgagatccagtccggcaaacaaaccgactgtggcttccgtatagtacggcccgtccatacccagtgctggcgcatccatcgcataagggcttaaaaagccgttcgccgagacgcgttggcggttgagcatccctaacgctgcgacctgtaattgtgaaccggcatctaacaaatcggcctgggactgcgctttttcttcccgcagtttcgcttcggcgagggtgtgtgaaccacttagcgtccgttggatcagcgcatccagctgcgggtcattgagttgtttccaccactgcgcctgcggccagccggagctggcaagatgaatatcatcggccagtttgatttgttccggtttgagctgttgatgaggcgcagaatccttacgtaccagggcacagccggaaatcagcgtcgtgctgccgagaatgctgcacaacagcagacgtgaaagttgacgattgatcattgcgtggctccttgtgcctgttccgtggcgggcgttaatgccggagctgtccagtctggcaagcgggcgaaaagctggcagacgtgttgctcctgttttaataaggtgggcaggatggcctgcgaggcgggtgtttcttcaagcgttatttgaggagaacggctgagtgcggttgccagaccggcagcgtatttctccagggcgtcggcaaactgacctgctctgtccggctgtagtgcgttatccagcgcctgcgccgagttccaggtggcatcccaggcgtgaagaatatcgcggccctgacgaataaccgtttgcgaacgttcaatcagtaatgcgcgttcttcgctgtccagttgacgctccagcaccacgcgttggcacatctcttcacaggcattaaacgccgcatgcagacctatgcgaatttgcagataagtgcgcagagccgtgacttcctgctggcgtgggatccgcattactttactcaacatacccagcgcgccagccagtttttgcggcagcgtgcgtgcttcgctttcaggccagacaaaggtgtaaatcaccgcggacaccacggtaccaatgatgatacccagagcgcgatcgcgaatttccaccaggtcgtacaccgggccaaaaacgttttcgagcgtggcgagcgcgaaggtgaccaccatctgtgtgccgatataagaagagcgttcagagctggtggcaatccatgcgcccaacaggaaaatcggtgccagcacaaacagcaattcgacaatattgtccagccagggcatgaccagtagcgtgaataacagtgccagaatcgcgccgcaaaaggccccaccaaaacgcagcaccatcttctggtacgacgaaccgacatttggattagcgacgatcacgcaggtcagcatacaggtgtgaatgccttcccagtccacgccgctgtagaaggtgtaacagatcaaacaggcgagcagcgtttttaccgcgtagcgcatatagtctggattggtaaaagcatcggcgaccattgatggcggtttggctgcgggcgttggcggcgtattcgggtccatctgaccaagctgtaacagcgtctggcagatattctccaggttacattcccgtgccgccatcgcttcactttcactgatccgccagtcgctttgccagcactgaccttcggcaatggtatgttgcagcttgttgatttctgagactaatttttgccgaaattcaataattgcctgagaatcagcaaaagaggtgggatcgtagcgattcagcgtcgagtaaatgtaggttaccgttgccacgcagctttgccaccatgcgctctgggttcgccagttggcatcatccgcgaggcaaaagacattgagtttttgcagcgccagcgcctctctttcaatccgcgtttcgggtagcggtgcgaggctgtccgtcaggtggctaatggcatcatcaagccgatcattaagcgcctgatgcatctgcgtaatggcacgactgggaaaccacagcacgccgattaacgtcatcagcaaggttggatagaggccaacaacgatacaccacagcgttaagcgcacgaccacttccggatagtcgagcatggcggggaaggtttgcccgtaaatagcgacaatggcgacggcgaaaaagaccagtcccagccgatgggtgcgcatcaaaaacatgcagcccatcaggatcggcccggcgatgatcaatcggatcaacggttcgccatatgaccatttgtagatcaaaaacaggctgccgatctccagcaccgtggcaaccacaaacaagatcgcgacaaatttggtgtaaaacgcgttcgactgaataccgtaaaacagcactgccagtgataacgccacaaaagggatctcaaaagtcatcgagatcagaatcaccagcaggcagcctacccagagttgcatagtctgtggcacgcgccctggtcgccgctcgcttaactcttcatgaaagaacgccagcagcctgaccaccggtaatggcagggagttgagcgcgctcattattgtggctcaagattagcgactgccgaagcgccgatgcggaacatttccgggtcaggtttatcaaccatgattttgaccggaaaacgctgggcaacgcggacccagttaatagaccgtgacactttcggcaggccgcccagcaccaggccgccgtcatccggtagcacgccgtagccaatcgaatccactttaccctcgaaggttttgccgctgtcgctcatcaggcgaatggttgcgagtgtacccgagcgaatatttttcagatcagtttcgcggaagttggcaatcacgtaccagtgacgagtgtcgattagagtgaaaatagggcgcatcgcagatgcaaactgcccgacggaggttttgagggaaatgacccggccatcaaacggcgcgcgaacggtcgccatttccagatgcagtttcgtcaacgcaatatccgcttcgactgccgcacgttgcgccaccagcgcatccacgccgctgacggagctggcggctgactgcgcctgcaacaatacggcattaaggtccgcttctgccgcacgctgtgcggttcttgcacggtcaacctcttccgcagaaacaaaaccttctcgcagtagcggttcggtacggcgtaacgtatcgctggcttgtttcgcggcggcacgggctttttctaccgtggcattaaccgagtcggcaccaaactgttgtgcgtcaacgctacgctgggtgagcataatttgcttatccagcgccgcgagggaggcttcagctttcgccagattggcttcgtacgggcgcgggtcaatgcggaacagcaaatcgccctgtttcaccgcctggttgtcggtgaccgccagttctacaatgcgaccgctgacttccggcaccacatcaatggtatctgctgacgcgtaagcgtcattagttgatggcgcactgtctacgcgccagataacgaaaacaagggcaaccagcgccaacgcaaccactaacagagcagggaatttactgcgaggagcttttttcggcgtactttccatgagcgcgtctcaaatagattagaaaaatgccagccagaacagcatggcgtagagagcaaaaagggcggtataaataattccgacaaatgccagattgatatttgtccgctgaataattcgcctcgtgatgagcgtcaaaataaggctggcaatagcgcagaaaaaccagccgggataataagcgccgatcaccgggattgccggagataatgagcatcccgaaaccatgaagacgggaattatccaggctgtttttttgagttgcatcgccatgcgagagagaactgttggcatattaaatacatcctgtctgctgcgaacaatatctgtagtgaatatcaatatccattgaaggcgtcagtatggctattttctcgatgaataaaaatagctttattcagccaccgcattcataacttatatattttatttattaattggctgtatatatttttaaagcaaatgctttgggggcttcagcgcccccaaaagcgagtgacattaatttggggttacgatattcacccacaaatcgaaattatccagacaggcgataatttcttccagtttcgcgccattgccaataattttggctttcttcgctttcacctgatcggccatttttgcctgtccggtcagcacggcgtgcagatcttcacggctgatgtagaaagaggcgtcagcttgcggttgcagtgttttacggtagttaagcacgctatcgttcagcgtcaggttgaggttatcgccgttgctcatattgaagttcaggctgatatttttacccgcggctttcacgctatcgaggcgaacggacataaagtcgaacagcatttcgaccgacatcccgcgaatggtgtccggggaaccggtggtgccgtggctgaacttatgcaccccttcgcgcagctctttcgcgccggtcaggtagaaaccgcgccaggtggcggactcggcctgatagcccagctgttcaaaattattcgcttgcagattcttcgcgacctggtcacccgggttggcggcaatcacctgtttcagcagttctgccgaccagcgataatcaccttgcttgttcgcttcttgcgccaggttgatgacgcgggcagaaccgcccagcgcctgcacgtaacgtttacccatctccacctgaccatacggatgcaggttagccgggttaccgtcgtaatagccaagatagaagttatacaccgcgcgggcgttgtggctgacagaaccgtaatagccgcggctggcccagttattggcaagcgcaggcggcagcttaatcatgtcgccgatttcattcatggtgtagccttggttcgccaggtgcagggtctggtcgtgaatgtacttgatagtatcgcgatatttaccaatataatcattgatatgcttattgccccagaccggccaggtgtgcggcataaacagcacttccgcgtcgttaccccacatatccaacgtttcgttcagatactcggtccacttgctggtgtcgcgggttttcgcgccgcgcagggtgtagaagttgtgcagggtatgcgtggcattctcggcggtacacagggctttcagggccggaatatagaagtgcatttccgctggcgcttcgctacctggggtcatcaggaagtcaaactccaggccgtcgataatcatcttctcgccagttctcacgatagttttagtcggtgcaataatgcttgggtcgccggttgccagcgtcacgccgaggccgttgcccacgttgccttgcgcgttgtgcggcagtaacagaccgtaagagtagagcgcacggcggctcatgatgttacccgccagcacgttttcgctgatggcttcgtccataaagccagctggagcaatcacctgaactttgccggatttaacatcggcttcagagataatacctttcacgccgccgtagtggtcggcgtggctgtgagtgtagataacggcaacaatcggtttttgcggacgatgctggaagtaaaggtcaagtgcggcttttgcggcaggtggcgtcaccagtgggtcaataacaataatgcctttctcgccctcaacgaacgtaatgttagagatatcctggccgcgcacctgatacattttatcggtgactttgaacaggccagaaatgccgttgatctgcgactgacgccacaggctggggtttacggtttccggcgcagcggcattaatatcaaatttgtaatcattcgcgcggtagtaaattttaccgttcgcatcacgcagaataccttcatccagcagcggagcgataaatccacgctgagcatcgtcaaaatcctggcgatcgccaaacggtaatgatttggcgtaattctgattaacctgttgggtatattgagtggcggctttcgcctcatctgttgcgtaagcggtatttatcatcatgccgctggcggcagtgaacgcaataacaatcctgctcaaacggaataaccgagagttattcatataaatctccatttatcatttatgtcgtaaatatgtaatccatgcaaaatacgtcatttaaagctggcgttatcataattctgaaattgcgactttaataagtggaagtgtgagcggaacgagccattttattaggcatttgtgctgaagagggaaaattacagtagaactatcattgctgggaataatatgggctgttttatgtaattattatatatatattgtacctgtcgttggcacagcgggacattgcgctactgtgccaacgctttactcatgggactttagcacaggactgtggcaaaaaacgttgatgcgccaatattgctgcaccctgagcgccattaaagtcagaagatgaggcggcaataaagcgcacaacctgatacggcagtggacggcgcaggtacttttgggtcatggcaatgagagtctcgggtgggaaggcgggcatatccatcacgccaccacccagaatcaccgcatcgggatcgaacagattaatgctggtggcaatggctcgtgccgcgttttcaagcagactctggacgaaaggggcgttttccgcatggacgaaaagatcgctcaatgggtaatttcggggctgttgttcgtaccagcgtcttagcgccattccagagcaattggtttccaggcacccaggattaccacacgcgcagtgttgggtcatatctcccagggggatatggcccagttcgcctgccacaccgtgtgcacccgtccacggcgcaccgttcatccacactgcgaaccccatccccgtaccgagataggctgccagaaccagttgttgcgtaaggcgattttctactacgtcccaggagagttgcaggttaacgtcgcgggaaaactcaaccggacaattcagcgtattttcgagcttatcggcgagatcatataaatctgccgctgttaacggcaggttaggcgtagaaataatggtgcgtttatctttactgaccagcgccggaaatcccatcaccagaccatgacagcgagcgttaaagcgcctgagttgctcgtcaatcatttcgccgatacccgacaccaggtcgggagcaataacttctgcggtccgctttttttcgcagtgtagcgtttcaccttctgctgtccgcagacaaaagcggatatgcgttgcccccatatccacgcccgctacgacgttatgctgtttttgcatgaggctgtacctcgctttttgcagccagaatctgcgcagtcataattctccatgcttcgtcgatattttccgcatgattaaacaggccggaagtgccgacgataaagacatccgcccctgccgccattagtttttcgtaagttgcctggttgcaggaaccgtccacctcaatttcgtactccagaccttctcgttcacgccatgccttcagttcggcaactttatccagcatttcaggaatgaagggttgtccggcaaaaccgggatcgacagtcatgaccgtaattttatcagccttatggatatagtatttcatggcctcaaccggcgtttccggattaagaatcagccccactttcatgccatgacggcggatttcatcaatcaggcggaatgcctgaccgttgatagtttccggatgcaaagtgatgaaatcagctcccgcacgtgccagttgagcaatgtaatcctgcggacgcgttaccatcagatggcagtcgagcggtttactcgccagtttttttacctggcttacgaagaacggtgagagcgtcagattcggcacaaagtggccgtccatgatatcgatgtgaaagtaatcggcatggctgtcgataaattcgatctgttctttaaatttcagcagatccatacacattaacgagggggagattttcatgttcaattccttacttactgataagacggtcaagggcgacagccgcgataattaatccgcccatcaccaccagttggtaataggtttgtacctgcaaaatattcagaccgttgttgatggtgccgatgatcaacccgccaatcaccacagagaaaatgcgccccttgccgccgaagaaactggtgccgccaatgatggcgctggcaatggcataggtttcaaaacccataccggcaagcggttctgcggcaccgagtcgtgcagttgagacgacgcctgccagacctgcacaaacaccggagatgataaacaccaccaggatgtggaatttcacgtcaatcccggaatagaacgccgagtttttgttgccgcccagtgcgtagatgttgcgcccgagccgcatacgcgttgtcagaaaccaaaggatgagcgcgacaattagcgagaagataacggggacaggtatcccaattacgctggcggcaaagaagttcacgaagtcaaatgagaagccgtataccgagttggcatcggagatcaccagcgtgatcccacggaaaatagcgttggtgccaagggtgataatgaacgggtgtagtcccgtccagttgaccaggcagccgttgatcgcccccagtgcgccgccaaccagtacaccgccaattagcgccgcgagaaacggatcaatacctgccaacatcagtttagcggtcaccataccggaaagcgccagaatcgcgccaacctaaaggtcgataccggcgaccaggatagcgaagaattcccccatgccgatcagtaccgtcacggagctttgcacaaaaatctgggtaatattattggtggtcagaaaatattctgacgacagcgaaccaaaaatggcgacgatgatcgccaggataaaaaaggtgccgtatttatcccagaacagcgcaaagttgaacggtttcttctcgctcgcttcgctttttactcgtgtggtaaagcccatgccataatctcctcttcgctcatgtcatcgcgattggtcaggatttgcgtcagtcgtccttcgcagaacacggcgatgcggtcgcagacggtgataatttcaggtagttcagatgacaccatcaggatgacttttccgtcgtccgccagttggcgcatcactttgtaaatttcggctttcgcgccaacatcgatgccacgggtaggttcatcgaaaatgatcacttccgggcgacagcacagccatttggagatcaggactttctgctggttaccgccggagagttcagtgatgttctggtttaccgaatgacatttcagcgccagcagttcgcgttgattttcagcggtacgttgctcgtcaacttcatgaaacaaccccatcgcgcctttatagccgccgtctttcagactgcagctgatagccatgttctgagcgatagaaaagttggggaaaaagccgttatcccggcggctttcagtgatgtaagccatcccttttttcacggcatccaggggagaacgtggagagatatctttgccattaagacggatttctccgccagcgcgtttatcaacgccaaacaggcagttcatcagttcagtacgtccggaaccgaccagtccggcaaagcctaatatttctccccggcagacgctaaatgagatatcccggaccttttttctgtcacggctggtgacgttgcgcacctcaaaaaccgtatcgtgcgcaaggttgctgacattctccttcatcgcgttaaaacggttttgcaattcgcggcctaccatcagacggacgatatcgtcatttgacacatcgctcaccatgccgctgcaaacgctgctgccgtctttcatcaccgtatagcggtcgcaaatacggcgaatttccgccaatttatgcgagatatagacgatggccgtaccctccttacgcaactgattcatgatcagaaacagatagtccacctctttattggtgagtgaggaggtgggttcatccatgatgatgactttggcatcgagcatcagcgttttggcaatttccagcatctgcttgtggctgatagataaattcgccactttctcatctaaatcaactttcaagcccacgcgtaataacatcatggcggcgcggacacgcatttctcgccagtcgataatattgacgccacagatttttttcgtcagatgacgaccaatatataaattttccagtacggttaattcatcaataacgctgagttcctgataaataatcccgataccgagttgtgccgctaatttatgatccagtttgttatagttaatgttattaatggtaatggtgcctttggtcggctcatgtatcccggataacactttcattagcgtagatttacccgcaccattttctcctagtaatgcatgtatttcaccaggataaaccgttaaattaaccgactttaatgcgtgaaccggaccaaaggacttgccgatccccgccatcgatatatatggcgtggccataaataacctctctgcacgaaatatcgtattattgcctgatggctacgtttatcaggtctacgttcaggttattttgttggccggataagacacttcattagcatcatcatccggcatcattcagttttattgagtgaccaggattgaatcgaccagtttaaattccggtgctttatccagcgggataaccttgccggatttctcagcgtcaaccatcagcttcagacccgttgcaccgatatccgccgggttctgggcaaccgtcgcggtcatttgtccggcttccaccattttgcgggcttccggaatgccatctgtaccgacgaccaacactttgcccgtttttccagcgtttgcgactgcctgagcaacacccattgccatcgtgtcattcgcgcaatagatcgctttaatattcggattacgttgcaacacgttagtggcgacatccagtgctttaatacggtcccagtcggcaggctggctggcgacaagcttgatctggcttgcttttttgaaggcttcggtggcaccattacgacgcgcttcaccggaggcgttaccggctttaccctcaatgattgcgacttcacccccttcggcacccagcttgtcaataatgaatgacgcgcctttcgccccgacggcaacattatcggtggtgacaaaaccttccacattaccgcctgcttttttcagattatccatgtcgattttttcatcgagattgaccagataaatgccttttttccatgcgcgggcgacaggcatgaccaggttcactgaggataatggtgcgaaggcgatacctttgtaatttttattactgagatcttcaaataactgcaattgagattgaaaatcgccttctgaaggagaggcaaaaatatcaacgctgacgcccagcgtttttgcttcatcttcaatgccttttttcatatctacccaaaatggattggagagtgttttcaatacgacggcatattcggcggcagcaaaagcgctggttgacaacattaagcccacgagtgtgccgctgaaatatttcagatatttattcataatcatgttctcacggtaaggggagaggtaactccgcgatggcggaattacctttttcttatttcagcgcgcctggtgagaagaaatcaacaattgcgccggttttttgcatattaatattagcttgttcaatattgagctgggcgacagagacaaaaaacgcgtccagcaaagtcagttgtaatattcttgccgaggcattacgacctaataacggtgtttccggggccggtgagcaaataatataatcggccagcttcgctattggtgaatgatagctatgcgttatacaaataatctttgccccgttcttttttgccagttctacagccgcttttacatcactggttcgcccggaatgggtcaccaccagcaccacatctccttcctgtaacaacgaagcagacatcatcatgatgtgagcgtccggataggcctggcagcgtacgccaatgcgcaaaaacttgtgctgtacatcagcacagatagcatttgatcctccggcaccgtacaaatcccgctgtctggcctgatagaaaaagcgggcggcacggtggatctcatcaacgttgacgatcgactgaccttccataatggtgcgtaaagtgatgttaaataccttattcaccacatcctgcggcgcttcatcaaaagccaactcggaaggcaatacttgttctgactgagaaaaataatcttccagcgcactgcgtaagttacgaaagccgctaaaccccagcagctttgataccttaacgatcatcgcttcagataccgccagagcttctgcgacatctttaattgcgggtgcacaactcaggttaccgggtttgagtaaccactccacgatgcggctttcgttttctgtcattccttcctgcttcattcgcaggtaaggcgctaacccgataccgttcggaagcgctgaatcaaactctgactggctcatcacgttctcttgtccttgaattgaagacgccactatatcaccacagcaagaacagaaaagatgctggcaacttcacaaaaaaataaaatttataaagtttgttttgttgtgaataatggagagtggcttaaaatttcatttcatttaatcactttaaaaacatgatgttatttgttttcctggtttattagatgatagatgttgctggatagtgagtgtctttaacgctattgcgctgccagatgtaactctgtaaaacagatcgggaaggcggatttcatcgattttgggtgtttttaattcatttacatcacaaatgttttttgattgtgaagttttgcgcgggcggggaagatgaatgaaaaagattgcatttggctgtgatcatgtcggtttcattttaaaacatgaaatagtggcacatttagttgagcgtgacgttgaagtgattgataaaggaacctggtcgttagagcgtactgattatccgcattacgccagtcaagtcgcactggccgttgctggcggagaggctgatggcgggattttgatttgtggcactggcgtcggtatttcgatagcggcgaacaagtttgccggaattcgcgcggtcgtttgtagcgaaccttattccgcgcaactttcgcggcagcataacgacaccaacgtgctggcttttggttcacgagtggttggcctcgaactggcaaaaatgattgtcgatgcgtggctgggcgcacagtacgaaggcggtcgtcatcaacaacgcgtggaggcgattacggcaatagagcagcaaaggaattgagattcatccactacttgcatggatgagtaatgactaatgtggatagagtttctttttgaggttggctaatgaaacgctttccgctatttcttttattcaccctgctcacgctgtccaccgttccggcccaggccgatattatcgacgacaccattggcaatattcagcaggcgattaacgacgcttataaccctgaccgtgggcgagactatgaagattcgcgcgacgacggttggcaacgccaggtgagcgacgatcgtcgcaagcaatataacgatcgccgccgccagtttgaagatcgccgcaggcagctggacgatcgccagcgccagcttgatcaggagcgtcggcaactggaagatgaagagcggagaatggaagatgagtatgggcgttgatataggggccggcgcgggtattttccctcacgccacctcaatatccatcccatcaaaccccgcctcaaaccccgatggtagcgcgttttccatcagccacgcatcaaactgatggctgatatgggtcagaatcacccgcggcgagcggataacctgattcagcgcaagcacggtatttaaatcacagtgattacgcggtgcatcctcgcgcggcgggtggctgcaatcaatcaccattacctgtggctgattattgcgtaaaaatttcagcgttttttccggcaggcctgcagtgtcagacagccacgccacccggctatgtgccgtttccagtagatagccgaaagtgagtttcgaatggttaagcggcagcggcgtgacctgcaacccctgcaaatcaaacaccacaaacggctccaccgtgtggctgaaatcaagcaggcccggatgtttaaacagatcgtcgcagccctgctcatccggtggaccgtagaccgggattgtgtcgcccacgccccagcgcagcgggaacagcccctggacgtgatccatatggtagtgcgtcagcaaaaactgctggaacgatccgggcgaccagcgatcggcgagatcgtgcagcccggcgtcgatcagggtgatcgcgtcgttaaacttcacgacgccgctgcatggctggcggcgatactgcggcgagcgtcgcgctctggcgcaggccgcgcactcgcagccccatgccggaacgccctgtgcgccgccggtgccggtgagcgtgagggtcaggctcatgttacagcgccttggtgaagcggaagtggctctgctcgtagccttcgcgcaggtaaaatcggtgcgcgtcgtggcgcttcacgttggtggaaagctcggtcatttcggccccggcctggcgggcttcttcttctgcccatgccagtaatttactgccgacgttcagaccgcgcgcctgcggcatcaccaccagttcctgaatttcgccgatccagttgacatgatgcagatgaaactgcaaatgcaggccgatcatgccgacaacctcgccatccaacagcgccagatggtagcgcatattcgggtcacgcaggttggcgttaaagcccacgcgaaacgcctggtggtcaaactccgcttgttttagctcacaaatcagcgcgtaaaccgcgtcggtgtcgtactgcgttgccgggcgaagttcacaagcaggcatggtgtttctccttctgatgaatcagcgtcagcagcgtgtcgaccgactggcgcaggctgccgtcattattgagcgtatggcaatcctgaggagtatagcgggcggcgcgcgccagccgggcattaatttcactggcgttttcgcggccacggttttccaggcgctggcgcaggatctccggcgaaacctgtaaacagatgggcagcagcgccgattgataacgcgcccgcgcctgcggcaggtgggcgcgtgagccgttaaccacgacgtcgaatccggcgtgcagccagaggtcgatctcaatgccgacaccgtaatacaaaccattagcatgccagctcaaggccagaaggttctgccccgcgcgggtaaaaaactcctgctcgcttaaggcgatatggttttcacttccggcgctggcatcacgcgtgatgtagcgatgcgctaccagtagctgggtttgttcccgctggcggagttccgtcaacagactgtcttttccggagccagaggcccccattaaccaaatcagttttcccgtcatcagaacacccttttaccctgacgccagacgtggtcgatatgaatgtggttgcccttgcgatgcgccagcaccaggtcggcgcgtttgccctcgccaatcaccccgcgatcctgaagattaagcgcctgcgccggatttttagtcaccagcttcaccgcctgcggcagcgtaaagcggttgctctcgtcatcggcgacgcgaaatgccgcatcgagcaggctggcggggtagtagtcggaagagaggatatccagcaggccaagctgtgccagttcactggccgccacgttgccggagtgcgaaccgccgcgcacgatattcggcgcgcccatcagtacgttcatgccatgcttgcgcgaggcttctgccgcttcgaacgtggtgggaaattcggcgatcacgctgccaagctggtgggattcggcaacgtgggcgtgcgtggcgtcatcgtggctggcgagggcaatgtgtcgcgcgcggcacattgcggcgatagtttcgcgattaggctgtgaccagcgtgcggcaagcgccagttgctcctcttcgtactgttgcatctgcgcatcggtgagcgagtatttgccctgataatattcacgatatttttcgcggttggcgaactggcgctggcccggtgagtgatccatcagcgacaccagcgttaccagttcgcgctgtaccagtttttcaaacagcggcagcgtggtgtgatgcggcagttcgcagcgtaggtgcagacggtgctcggcacggttgacgccgcgtttctgcgtctcttcgatggcgttgatcatcttctccagattctccagccgatcgccgccgtcgcgtacatcaccaatcgccacggcgtccagcacggtggtgatgccgctcgccaccatcagcgcgtcgtggctgctcatcgccgagtgggctggccagtcaactttcgggcgcggggtgaagaatttatccagattatcggtatgcagctcaatcagccccggtagcagccagccgccttcgccgtccattgcttctgacaggtgactctggctttcggcaaaggcgcggatttcgccgtcctgcatctccagagaaccgtgtaccacctcgttttccagcaccagtttgacgttattgataatcatgaagagactcccattgggtgcaggcggtcggcgacttgctcgcgcacggtttcgtcatggaagataccgacgatggccgcgccgcgggctttggcttcgcggatcagttccactacggcggcgctgtttttagcgtccagcgaggcggtaggttcgtcgagcagcagaatggggtagtcgacgataaagccacgggcgatgttgacacgctgctgttcgccgccggagaaggtcgatggtgccaggtgccacaggcgttcaggcacgttcaggtgggtgaggagacgcgcggctttagcggcgcaggcttcacgcggtacgccggtatcgagcagcggctgcatcaccacttccagtgccgaaatacgtgggatgacgcgcagaaactggcttacccagccgacagtggttttgcggatctccaccactttgcgcgctggcgcggtgaccaggtcgacccattcatcaccgtgtttgatctggatttgcccttcgtcgggtagatagttggcatacagcgagcgtagcagagttgattttccactgccggaatggccgtggagtaccacgcattcgccggcgttgacggtgagtgaggcgccttgtaatacaggcaggcgcacgccgttttgctggtgcaggatgaaggttttactgacgttttgtacgttaatcatttttcgcctcgtggttcgggtgtcggatgcgacgctgatgcgtcttatccgacctacggggagcgcatttgtaggccggataaggcgtttacgccgcatccggcaccagctcaattctgcaaaaccgatgacaccagcaactgggtatacggatggtgcgggtcgtcgagcacgcggtcggttaacccactctccaccactttcccttgcttcattaccagcaaacggtccgccagcagacgggcgacgcctaaatcgtgggtgacaatcaccaccgccaggttaagctccatcaccagaccgcggagcaggtccagcaggcgcgcctgtaccgacacatccagcccgccagtgggttcatccataaacaccagcttcggatgcgtcaccaggttgcgggcaatctgcaaacgttgctgcatgccgccggaaaaggtggtcggcaggtcgtcgatccggttggcgggaatctccacctcttccagccatttctgcgcggtggcgcgaatatcgccgtaatgacgcgctccggttgccatcaaccgttcgccgatattgccgcctgccgacacctggcggcgcaggccgtcaagcggatgctgatgcaccacaccccattcggtgcgcagcaggcgacggcggtcggcctcgctcatcgcgtacagcgaacggttctcgtagcgaatttccccttgctgtggtgtcaggcgggcggagatcgacttcagcagcgtggtcttcccggagccggactccccaacaatgcccagaacttctcccggccataaatcaaaagagacatcgctgaagcctttgcccggggcataaaggtgggtcaggttattgaccgaaagtaacggttgattcattggcttttggcctcgttctgttggcggcaataatcggtatcggagcagacaaacatgcggtttccggcgtcatccagcaccacttcgtcgaggtaactgtgggtcgatccgcagatggcgcatggttcatcccactgctggacggtgaacggatgatcatcgaaatcgaggctttccacgcgggtaaacggtggcacggcatagatgcgcttctcgcgccccgcgccaaacagttgcagggcgggcatcatgtccattttcgggttatcgaatttcgggatcggcgacgggtccattacgtagcgcccgttcaccttcaccggataggcgtaggtggtggcgatatgaccgaagcgggcgatatcttcatacagtttcacctgcatcacgccgtactcctccagcgcgtgcatggtgcgcgtttccgtctcacgcggctcaataaagcgcagcggttcggggatcggcacctggaagataatgatctgatcttcggtcagcggcgtttcgggtatgcggtgacgcgtctggataagtgtcgcatcgtccgtgcgctcggtggtgttcaccccggtcacgcgcttaaagaagttacgaatcgacacggcgttggtggtatcgtctgcgccctggtcaatcaccttcaacacgtcgctttcgccaatcacgctggcggtgagctgaatgccgccggttccccagccgtagggcatcggcatctcgcgtccgccaaacggcacctgataaccggggattgccaccgcttttaagatagcgcggcggatcatgcgtttggtctgctcgtcgaggtaagcaaagttgtagccgctcagattagccatggttctgctcctgttgcagacgtttgagtagctccagttcggcctggaaatcgacgtagtgcgggagtttgagatgcgaaacaaagcctgcggcttcgacgttgtcggcatgggccagcacgaactcttcatcctgtgccggacctgttgcgtgctcgccgtattccggtgcctgcaacgcacggtcaaccagcgccatcgccattgctttgcgctcgctcatgccgaacaccagcccatagccgcgtgtaaaatgcggtggttcatccggcgggtcgataaaaccgttgaccatttcacactcggtcatcaacaattcgccgacgttcaccgcaaatcccagctcttccggcacaataaatatatcgatatagccactgcgaatttcgcctgcgaacgggtgattgcgcccgtaaccgcgttgggtggagtaggccagcgccaacaaatagccttcgtcaccgcgcattaattgttgtagacgggaagaacgcgaacagggataaaccggcggcgtgcgggtgatgtcgtccggttgtgcgccgctatcttcttcaaacttcgccagcccctgacgcgccagcaggctgaagacgtgtggcgacggttgctgttcgctgtcagcggtggtcagcgttggcgtttcgccgtttgccagcagggtgaaatcgagcaggcgatgggtgtagtcgtaggtggggccaagcagttggccgccgggaatgtctttataaattgctgaaatacgccgttcgagacgcatcccggtggtgtcgagcggctcactgaccgccagcttcgccagcgtggtgcggtaggcgcgcaacaggaaaatcgcttcgacgttatcgccgctggcctgtttcagcgccagcgcggccagctcgcggtcggcaataccgccttcggtcatcacgcgatctaccgcgaggttaagctgctgttcaatctgggcgacgctcagttcaggcaaatcagtatcgccccggcgtcggctctcttgcagggcgtgggcggcgtcgatcgccttttcgccccctttcacggcaacgtacatcagcacacctccacatgagtggttcgcggaatagccagcaggcgctcgccgcaggtcaggatcaggtcgatgccgagcgggaacgggtgcgggcgctcggtaagttcatgaagaatgcactttggcagttgcggggcgatcatccgttcttcggcaatacctgcgccggtgaggcgcaacatacgcccaccgctcaggctggtgacctgtaaaatcagcgttgcgcccgcttctggtgcaacggcagtgccggtggaaagggcgttgagctgctcgctggagatcgcctcatctgttaccgcgaaggtcgcctgtttcggctgattaaccagcggcgcgttggtatgaaaacgcaggctctgattgacgatatcgttgctcaatggcgcggcaagccacaccggcgtgtcgttatcggccagcgtcagcagcacgctggtggtggcgatattcagcggctgccagccgcgcttgagctgatgcagggcgacaatcacgcccggctcgctcatggcctttaacaggcgacgaaaactgtgttgggcatcctgcacgggaagcataaaagcggtttccagggtcatgcgttgtctccgcgaaccatcgtaaagaagtcgacccggctggcgttcacttcggcctggcgcgcggcaatgcgtgccatacggtcagcgtccagcggggtgataagggtttctgataagttttgaaagtggcggttttgctgcatcagcgcatcaatcagcgcacaacgttcggcgtgctgtttgtcgcgccccagcacccagctatagccgagcgtgccgtcagtcagacgcacggcggcgcgggtgagcgtggcgtcgccagcaaaaaagcgttcgccggtgccgcccattcgcgcctgaatctgcaccaggccagtttcagcggcgcggatcacctcataatcggcgttgatgttcagcgcgttcaggcgggctgccagttcagccggttggctgtgcgccagcacggacatccagtgctggcgggtcgcggtatctgcgtgcattcagtgctccatagtgaattcaatcatgtcggcgcgcgtcaggctgacggagtactccgccgggctgctttcaccgtcacggtggttaagggtgcgcacgcacagcagcggcgacatattcgggatttcaagacgctggcactctttggcctgggcgcggcgggcgctgatccgcgtctggctgcgtcgtagcgtaatccccgtttgctcgcgcagaaaatcgtgcagcgaaccgctgtcgaaacgttgcagcgtcggccagagggtgaggtccgcaaagtagtggtcgattaaacagagcgcgacgccgttgacccgacgcagggtgcgcaggtggatgacgttctccccctcggttatccccagcgcgtcagcgacgtgaccggaggcggggcgcagcaccgatagcaatttttcgctggtgggatggctgccctggtccagcaggttctggctaaaacgcgcctgggcgttgagcgggtaatcgaacgggcgcatcagcaccagtacgccgacgccctgacggcgctgtacccagcctttttccaccagttggtcgatggcgcggcgcagggtgtggcggttcacctcaaagcgcgccgccagttgctgctcggcgggaagatagtcgccgcagcggtagtgttgacgaagctcctgctcaagttttgcggctatctcctgatagcgtgttgggtagctggtcggatgtgtagacaagtgcatagccatcaatgcctcgcttatcagataaagtgcttacgcaaccgttgagagaggaaatccagcaggctgaccgtgacgatgatgagcaccatcagggcgcaggtttgctggaactggaaaccgcgaatcgcttcccacagcgtgacgccgatcccgcccgcgccaaccataccgacgacggtcgccgagcggacgttggattcgaagcgatagagagagtaggaaatcagcagcggcatgacctgcggtagtacgccgtagaggatctcttccagcttgttggcaccggtagcgcgaatgccctccaccgggccgggttcaatcgcttctaccgcttcggaaagcagtttggaaagtacgccggtggtgtggataaacagcgccagcacgccagcgaacgggccgaggccgacggcgaccacgaacagcatggcgaagactatttcgttaatggcgcggcaggcgtccatcaggcggcgtacaggttggtagacccaccacggtaccaggttttcagcgctcatcaggccgaaggggatggagagaaccaccgccagcgcggtgccccagacggcgatttgcagcgtgacggccatttcggtgaggtaatcctgccactggctgaaatcgggcgggaagaagtcggcggcgaacgtcgccatgttgccgccatctttaatcagcgtaagcggtgccatttccgcgccctgccacgagacgaccagcacggcgataacaacggcccagctcagaagcgagaaccagctgcgcttgggtggggcgatggtgatggtttgcatgtttggctccggtctgtaggccggataaggtgcttgcaccgcatccggcatcaacgtctgcacattgtcggatgcgacgccggggcgtcttatccgacctacgatttactgcaccgctttactcaccgaactcattgcgcttaacgcgttgttcaggcggtccaaatcatccagttgcgcctgaatggcggtggtttttgccagcttgtcctgttcgttcagccctttgttgtccttcacgctttgcatctctttaaacagcgcgagctggcgaatcggcaccagttgcaggtcgctggaggcgcggaacggcgcccagcccaggcgttccagcaccgctttctcttccggcgttttgccgtagttcataaagaagtcgtagatcttgtctttggtggtttcggacagatttttgcgccagacgatcggatcgcctgggatcagcggcgatttccagatcaccttcagttctttgagcttctccggcgcggaggttttcagcttgtcgaggttttcggtgttattggtcgccacatccacttgcttgttggcgacggccagcgcattggtttcatgcccggcgttgacggtgcgcttgaagtcgctggcggagatattgtttttagcgaagacgtagtaaccggggacgaggaagccggaggtagagttaggatcgccattgccgaaggtgagatctttccgcttcgccagcagatcgttcaggttgttgatcgggctatctttgttgacgatcaacacgctccagtaacccggcgatccatccgccgcgaccgtctgggcgaagacctggccgttggcgcgatccaccgcttccatcgccgacaggttgccgtaccaggcgatatccactttattgaagcgcatcccctggataatgcccgcgtagtccggggcaaagaaggcgttgacctttacgcccagcttcttctccatatcctgtaagaacggcgtccattgcggtttcaggttttgctgtgattccgttgaaataatgccgaaattcagcgccttttcctgctcttcggcgtatgccggatttaacagggtgctgaggctgaacatgctggtgaaggccagcgaggcaattatcttagcgttcattcgttttcctcaatgatggggatgtcaggcagctttcgcgttctcttcgacgcggttaatgctgcggtagagatggtcaaaacgttcgttatcaaactgttggctgcagccgtcgtagaagacgtgcccctggcgcagggcgacgatgcgttcgcagtagcgcagggcgtaatccacctgatgcagcgtgacgaccacggtaatgccgtcgttctggttgatgtcgcgcagggtgtccatcacgatgcgtgccgattccgggtccagcgaggcgatgggttcgtcagcgagaatgaccttcgcctgctgcatcagcgcgcgggcaatcgccacacgctgttgctggccgccggagagtgtggaaacgcgttgatgggcaaagtgcaccatgccaacgcgggtcagcgcctgtaacgcgcgctgtttctgctcgcgggtgaagtagctaaaacaggttcgccagaatggcgtgctgccgagcgcgccaatcagcacgttctccagtacgctcaggcgattcaccaggttgaattgttgaaagatgtagccggtatgggcgcggcttttacggatatcgcgggccagacggccttcgcgctggacagtgcggcccagcagctcgatatggctaccgacagatttatcgccggtaatcaaaccgcttaagtgacgtaaaagggtggattttccggaacccgacggcccaagcagagccaccatttcaccatgatgaatgttcagatcaaccgcgtgcagcgcctgatgctgattgaaggttttggcgagcttctcgacacggataatcgtttgcatgatgcagcctccctaaaaaagtggctccatcgtggcggattattgtgacgatttggttaattaaaagtgactaacagatgaagagttaacgggaattcgatgacagtgcgggagggtgggcctcccggcgggttattgcgttggctgttgtttgacgacattaatcatccacggtacgccaaatttatcggtgactttgccgaagccatgcgcccagaaagtttcctgccaggccatttcgatttttccgttagcggcaaggttgtcaaaccagcgttttccttcttcgacctgttgcgaatcgagcaccagcgtaaagccggagtagctggcttttcctgacggtatagcatcgctcatcatgatgtcgcttcctgcaatgcgcacgttggcatgagcgatggcggtatcgggaaattgcattccggaagggcagttttcggcgctgtcctgcgctgatttcggcatttcgccgaagctgattttatagagcagttccgcgcccaacgtacgttgataataggcaatcgcgtcggaacagttaccggcaaaagagaggtagggacttaacggcatgatggtgacctcagttaagagaagcccgttaagtgtagttcgaaatttatacagatgagagggaagcctgataagacgcggtcagcgtcgcatcaggcagtcgccaccgttgccggatgcggcgtaaacgccttatccggcctaccgatcacaatacaatcagttctttttcacaaactcagatttcagtttcatcggaccaaaaccgtcgattttgcaatcgatgttatggtcgccttcaaccaggcggatgtttttcactttggtgccaattttcagcatcgaagagctacctttcaccttcagatctttaatgatggtcacgctgtcgccgtcagccagcagattgccgttagcatctttaacgatcagctcgtcgctttcctgtgcaggttctgcgtcgttccattcgtaggcacattccgggcagatgtacatgccgttatcttcgtaggtgtattcggagttgcattttgggcagtgtggtaatgacatgtggatttcctcaaaagtcagcagggcaaaagcgccaaaaaacggcagattgccgaaaaaggccgcaattatacacaaaatccctgagtttgtcgggggtactgctgattttagacgacgatcgttttcatttgaaaggaaacgcaaaaagaaaataatctttttgcctccatttattatttaagataaggttaatgctctacatgttctttttttaattcaaatgatattttttatctttctgacgttttaaacgtatcggaagacgttatttattctaataaaaaacaacactctaaatataaaattatttcttgcagtaattataaaagccgaaaacagaactcaaaaacaatctggctaaataaaagtaataaaatttgctttaaggaaaaattttctatgtacacacagaccctgtatgagttaagtcaggaggctgaacgcctgttacagctttctcgccaacagttgcagttactggaaaaaatgcctctctctgtacccggagacgatgcgccacaactggctttaccctggagtcagcctaatatcgccgaacgtcacgcgatgctgaataatgagttgcgtaaaatttcccgactggaaatggtgctggcgattgccggtactatgaaagcagggaaatcaaccaccattaatgccattgttggtacggaggttctgcctaatcgcaatcgcccaatgactgcgctgccaacgcttattcgccatacgcccgggcaaaaagaaccggtactgcatttttcacatgtcgcgccaatcgaccatttaattcaacaattacaacagcgcctgcgtgattgcgatattaagcatctgaccgatgtgctggaaatagataaagatatgcgtgcgcttatgcagcggattgaaaatggcatcgctttcgaaaaatattatctgggtgctcaacctatttttcattgtctgaaaagtttgaatgatttggtgcgactggcgaaggcgctggacgtcgattttcctttttctgcttacgccgccattgagcatattcccgtgattgaagtggagtttgtccatctggcggggctggagagttatcccggtcagttgacgttactggatacccccgggccaaatgaagccgggcaaccgcatctgcaaaaaatgcttaaccagcagctggcacgcgcctcggcggtactggcggtgctggattatacgcaactgaaatcgatctccgatgaagaggtccgtgaggcaattttggcggtggggcaatcggtgccgttgtatgtgctggtcaataagttcgatcaacaggatcgtaacagtgacgacgccgaccaggtgcgggcactgatttccggaacgctgatgaaaggctgtattacgccacagcagatatttccggtgtcgtcgatgtggggctacctggcgaatcgggcgcgccatgagttagccaacaacggtaagttaccaccgccagagcaacaacgctgggtggaagattttgcccatgccgcgctcggcaggcgctggcgtcatgccgatctggcggacctcgaacatattcgccatgctgccgatcagttgtgggaagattcgctgttcgcccagccaattcaggcgttgcttcatgccgcttacgctaacgcctcgttgtatgctctgcgatctgccgcgcataaactgttgaattacgcgcagcaggcgcgggaatacctggattttcgtgcgcacgggttaaacgtcgcttgtgaacaattgcagcaaaatatccatcaggtcgaagaaagtttgcagctattgcaactcaatcaggcgcaggtgagcggcgagattaaacatgaaatcgagttggccctgacctccaccaaccactttctgcgtcaacagcaagatgcggtgaatgcgcagttagccgcgttgtttcaggatgattcggagtcgttaagtgagatgcgtacccgctgtgagacactgttacagacggcgcagaacaccatcagtcgcgactttacgctgcgctttgccgagcttgagtccaccctttgccgggtgttaaccgatgttattcgccccattgagcaacaagtcaaaatggaattgagtgagtctgggtttcgtcctgggtttcattttcctgtttttcacggcgtagttccccacttcaacacccgccagctgttcagcgatgcaatatcccgtcaggaagcaacggatgagcagatcacccgttttggcgttgtgcgtgagattttttcgcgctggttgaatcagcccgactggggacggggaaatgagaaattcccgacagagacggttgattacagtgtgttgcaacgagcattaagcgcagaagtcgatctttattgccaacaaatggctaaagttatggcagagcaggtcgatgaatctgttacggcaggcatgaatacttttttcgctgagttcgcttcatgtttgacggaattacagacgcgtttacgcgaaagtctggctctgcgtcaacaaaatgaatccgtggtcaggctgatgcaacagcaattgcagcagactgtgatgactcacggctggatttacaccgacgctcagctgttacgcgatgatattcaaacacttttcacggcagaacgatattgaccaagacgttactggacggccccggtcgcgtgctggagtcggttcatccgcgctttttagtggatctggcgcagggcgatgatgcccgccttccacaagcccatcagcagcagtttcgtgaacgactgatgcaggaacttcttgcgcgcgtgcagcttcagacatggacgaacggcggcatgttaaatgcgccgcttagcctgcgtctgacattggtggaaaaactggcgtcgatgctggatcccggtcatctggcgctgacgcagatcgcgcagcatctggcgctgctgcaaaaaatggatcaccgccagcactctgctttcccggagctcccccagcaaattgtcgacttgtatgagtggttttcagcccgttgtcgctggaaggaaaaggcgttaacgcaacgaggcctattggtgcaggcgggtgaacagagcgagcaaatttttacccgctggcgtgctggggcgtataacgcctggtcgttgcctgggcgctgctttatcgttctggaggagttgcgctggggtgcatttggcgatgcctgccgtctgggaagaccgcaagcggtggcgttgttgctgggtgatttgcgcgtgaaagcgacacaacatttggcagagagtatcaatgcggccccgaccacgcgtcactattaccatcagtggtttgcctcttcgaccgtttcgacgggcggggagcatgctgattttttaagttggctgggaaagtggtccacggcagataaacaacccgtttgctggtcagtgacccaacgctggcgaactgtcgcactggggatgccacgactctgttcagcgcagcgtctggcgggagcaatggtcgaggaaatcttctctgtaaatttggtgtaaataatcagttacaccaatgagtcctaaacgaaatacatgtgtgaagttgatcacaaatttaaacactggtagggtaaaaaggtcattaactgctcaattcaggcgtcaactggtttgattgtacattccttaaccggagggtgtaagcaaacccgctacgcttgttacagagattgcatcctgcaattcccgctccccttttgcggccgtcgcgctgatttttctggcgtttgcggaaatgggccaactctgcgaggaaagctatgctgaaaaggaaaaaagtaaaaccgattacccttcgtgatgtcaccattattgatgacggtaaactgcgtaaagccattaccgcagcatcactgggtaatgcaatggaatggttcgattttggtgtttatggttttgttgcttacgcattaggtaaagtttttttcccgggggctgaccccagcgtgcagatggttgctgcactcgccactttctccgttccctttctgattcgaccgcttggcgggctcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcaatatttgttgcggaatactcccctgaccgtaaacgtggctttatgggcagctggctggactttggttctattgccgggtttgtgctgggagctggcgtagtggtgttaatttcgaccattgtcggcgaagagaacttcctcgattggggctggcgtattccgttctttatcgctctgccgttagggattatcgggctttacctgcgccatgcgctggaagagactccggcgttccagcagcatgtcgataaactggaacagggcgaccgcgaaggtttgcaggatggcccgaaagtctcgtttaaagagattgccaccaaacactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgttcaaccggtgatgggcttgctgagtgaccgttttggccgtcgtccgtttgtgcttcttggtagtgttgcactgtttgtgttggcgatcccggcgtttattctgattaacagtaacgtcatcggcctgatttttgccggcttattgatgctggcggtgatccttaactgctttacgggcgttatggcttctaccttgcctgcgatgttcccgacgcatatccgttacagcgcgctggcggcggcatttaatatttcggtgctggttgccggtctgacgccaacgctggcggcctggctggtcgaaagctcgcagaatctgatgatgcctgcctattacctgatggtagtggcggtggttggtttaatcaccggcgtaaccatgaaagagacggcgaatcgaccgttgaaaggtgcgacaccagcggcgtcagatatacaggaagcgaaggaaattctcgtcgagcattacgataatatcgagcagaaaatcgatgatattgaccacgagattgccgatttgcaggcgaaacgtacccgcctggtgcagcaacatccgcgaattgatgaataagctgaaacggatggcctgatgtgacgctgtctaatcaggtcaattgaactcttaaggttcacttaatctctgacgcgcatactctcctccaggttaacggaggagagtgcaatgaaaaaccgtgtttatgaaagtttaactaccgtgttcagcgtgctggtggtcagcagctttctttatatctggtttgccacgtactgatcttttttcagccgtatccaggcccgcgtgccggaagtctcttgccggttttgcaggaaaaactgcccgtgatgcaactgtgtaatgcggctgacaatacttaaccccagaccaatcccgccataacggctgtccattcgtacaaacgctttactcaactccccgcatttactctcatcaatacccggcccttcatcttcaacggccatgaccgctccgccatcttcttgcagcttaatcataatgttgctgccttgtgggctataacgatgggcgttttctaccaggtttcgcaataacatccgcagcagggttgcatcaccctgaacggtgatgtcggcggcgctctctggcaatagcagggtttgctggcgctggtcgagcatggtactaagttcgtcatacgaggggagaatgacatcttccagcagttttacatgttgataattaccggaagaaaatgactgtccggcacgcgccagttgcagcagctgggagacgctctccatcatctgatcaagtcgtgccactaacggtgctacatcaatgtgatgcgttttcgccagcagttccagatgcaaacgcacccccgccagtggcgttcgcagttcgtgcgcgacgtcagcggtaaacaacctttcgttatccagcgtgctggtcaggcgactgaccagatcgtttaacgccgaaaccaccgcatcgatttcgagggtggcgctatgaatggcaatgggcgttaagttatcggcggtgcgcgcttccagctctttttgcagctccgccagcggtcgggtgatgcggcgtaccgcctgatagcagataaatagcgtcaggctaaccataaagacgccggggacaatcaggctggcgaccgcctcgcggatctcacgcatgatgtggcgatcgttgttgcgattgtcgcgtagcgcctgctcaaacagctgaatctgctcggtactttcatgccacagccagaagacgctgatcagctcaaacaccaacaaaatggccccgatggtcaatatcagccgttggcgcagcgatattggtcggcgcagaaaacgcatcagattcaattagttttcctcatttgcgaccagcatatagccaaatccgcgcacggtgcggatacgggctttgcccactttgtcgcgcaggttatggatatgcacttccagggtgttggtcgagggctcgttgtcccagttgtagatatcgttgtagagaatttcccgatgcaccgggctgcctgctttaagcatcaggcgcgacagcagagcatattctttgggcgtcagaatcagttcttctccgctcatccatacctggcggcgacccatattcagcgtcaggttgccaacgttcagctcactttcgccctgattattatggcgtcgtagcagggcgcggatacgggcgtgcaactcttccagcgcaaaaggcttcaccagataatcgtcggccccgacatccagcccggcgattttgtcggtaagggtatcgcgggcggtgagaattaacaccggcagagtgtattttttctgccggatacgggcaagaaaatgcagcccatcttcatcgggtaagcctaaatccagtaccaccaggctgtaatgaccggcttcaaggctttgttccgccatccgcgcggtgctcacgccatcgcacgcgtagccttcggtttgcgccgccagaatcaatccctgcaataacagcgtatcgtcttcaacaatcagaattttcattcactcactctcctgcaagtttgcagaatatcatccgcagcctggtaatacttcgtctcaacgccagtcaggcccaataaggttgagaataaattgtcttgtgaatagtgttgcgtttgcgcctgtttttgcaggcagttctggtcaacctgataccgtttttgataatcctccgatagccacagcagcatcggcacctgtttttggctatccggggcgatggcataaggcagaccgtgcagatagatgccattttcacctaacgattcaccgtggtcagaaagataaaccaggctggtggtaaatttatcctgatgttctttcagcagattaatcgctttatcaacaatatagtcgacgtaaaccagcgtgttgtcgtaagtgttcaccagttgctcttgggtacaggtctggatctcgttagtgtcgcaggttggggtaaatttcctgaactgcggcggatagcggttgtaataggtcgggccgtggctgccgatagtgtgtaatacaatgaggccatcgctttgcagattattgatgtactcttccagcccgtggaacagcacttcgtcatagcattcgccgttgatgcactgaccaggcaggttcagcgcggtgacgttctggtgaggtacgcgatcgcaaacgcctttacagccgccatcgttgtcattccacagcacgttgatgcccgctcgctgaatgatatccagcacgccttcctggtgctgtgccagctcttctttgtagtgctcacgcggcatatccgagaacatgcacggcactgagacggctgttgctgtgccacaagaggcggtattagggaaatagaccacgttatcttttgccaggcgaggattggtttcgcgtggataaccattcagcgagaaattctctgcgcgcgacgtttctccgacgatcaaaatggtcaggtttttgcgtttcccattttgcattaatgggttgcggtgagcatcttcaccaatgcgtatcagtggcaggttggctgaccgctggtgagagtaccacgaccagctagcaacaatgctgttggacgggcttaaggatttcaccagttctttgttgttgcgaaacagcgatgcatagtctttgtagaacagtgcggcaaccagcagaatcagcagtacagaaatcaggatgttggccccgcggaaaagaacgctgcgcaggcgtgaggtggtgggtttgattttgatccagcaggcaatcagcgcagcaagcacgccgctgaatcccagcgttaataacatttgcggcgtcatcaacgcataactttctgccggagtggtatcaataatattggcaatcatcgagcggtcgatgacgatgccgtaagtcattatgaaatattgtgcagccgcgccaaccagaataaacaggcaggccagcggtcgattaagccacaagaaagagcttagtgtcaggacaatattaatcacgctgaaggcgacgaccggcatcgacaagaaaaccagtacgttatgcagcgagtccagcggcagcgcctgcaacacctgtttaaaaaaggcaatattcaggcagatagagatataaaaagcggctaacaatagccaggcgagtaaattcaaagagggtctttttagtaggcgcttcaacatcacggtgtttccatcgaacaaagtgcgcatatgctcgcaaagcaaaattaagccaaccttaagttcttaaggttggcttttatatttgcttgattaaggggaattaatctttgcttattggtgcatctaagggatacgggtttttatgcagccggttgtaattcagcgcatacatggcggtgattaccatcagagtgacaaatgaccacataacctctttcgcgccggaccctactacggcccagatgcagtagaggaaggcaatggtagtcactgccagatatgccgggcgtgctttaccaaagtgaccgtggccgagcagtagtaacgccgcacaggtgtaaagatatggcaccagtgtaaagatgaccgacacggaagaaaccagaccgaattctttggtcgcgtttggcgaaatgctactgagctggaagatggtcatcaaaataccgacgataatcagccccgccactggcgtgcccgctttatttacacgggcaaaaatcggtgggaacagtccgtcatcggcagcggctttcgccgtttgacccgccagcaacgtccagccgcccagtgaacctaagcaacccgcagctgcgcagaaggaaacaatggccccggcggtgtcacccaacgccatccgtgcggcatcaccgaatggcgaagcagaaacgcgcagtgcggcattagggatcatccccataatcgcggtggtagaaagtacatagcaaacggcagcaatcaataccccgccaatggtggcgatagggacgttgcgtttcgggtttttcaccacacctgcggcaacggaggcactttccacaccgatgaacgaccacagcgtaacgttaagggtactttgaatcgcaccgaaggtgcccaggccgctgacgttccatgccgccatataggtttcaccacggaaccagaaccagccaaatacggcaatcccgacgatggggatcagcgccagcacggtagcaacggcctgtacgcgggtgatcattttcggaccgacaatgttcagcaggacgaagatccacagcaccacgacgcaggtgatggttaataccaatggatctttcagaatcgggaagaagtaacttaaatatcctacgccaatgaccaccatagcgatattgccgatccagcaggccagccagtagaggacgttggtttgataaccgagaaacgggccaaagcagcggcgggcgtaagcgtaagaaccaccaggacttgggtcgaggaacgacattttggcgtataccatcgagagccccagcgcaccgataatcgtcaccaaccatccataaatggcaatcccgccagtggaggccaggtttgcaggtaacagaaaaacacctgaccccataatattccccgacaccatcagggtgacggggattaagcccactttgtgagcatcagcatccgaagacataattaaactcctgcgaaggcgagcttcgtgacaataaattacgtcatatcatacgcctgcattcgatagttgaattattatcggccgggttatcgctgatgccgttattaatatagctcttcgttaaggttaaaaatcaggcgacagtgcgttctctgtgctgactaacataatgcagcggcgtcataccgtagaagtctttaaagacagaaataaagtacgacgtactgttgtagccgcaggactgtgatacctgagagatatttttaccgtccatcattaattcatttacggcataacgcatgcggcaggtggtgattatttggctataactggtgttttcgcttttcagctttttctttaacagacttgggctaagacataaacaactggctaccatactaagattccagtctttgtggatatcgctttcaataatttgataaacgctgtcacttacacaattacgtaacatatacatcattagtgaaaggaattttttactgtcgagaaaacgggatagcacagtgaataataatgcacgtgttcgttccttttctgactcagtttcagcgggcatcatgctatgctgcgcggcaacgcgaaagacgtctggcgtcaggcatggcagggtgaggatgggcgtagcgctacgttgccatactggtatttgcgagagatctttattcagaaaccggaggtaatctttgatgatgtcgtgactaatatgagcaaccaaagtgttattaagagaggagacgtcgataatattattttcacaatttaataacgccatgtggttagctttaaggctaataggttctttcccattcacccttatccagacatctttttcagtcaataaaacaatacaaggttggtcgctgcaaatcctcatacatgtactcctgagtgcgaataaaagaccagttctcgctaaagcgaagcgataccgggaaatggttatataattgtatgatgaatataaacatgcataaaaataacgagttttactaatattacaaatttttatagtaatttctcatgtacatatttttttacaggctaaaaaaaggataaataacaggcaaaaaaaagcgcggggtgggaccgcgcaaaaagcatgacattttttgtttgcagcaatttttatgaaaacgttgccatacttaaaaggcctcaagccaggcggcgtaatgttatttaacaattacgccttcagcggaatagtggttacgctttcacacacataacgtggtaaataccgtcaataatttctgtcccttctgtttcgtgttcaaatccagggaaatgatggtcccaggattgcagcgagcgtaaataacttacttgcggactgtttttatcgccgaagttttcaccagacagcagcatcgggattcctggcggatacgggataactgagtttgccgcgatacgtcctggcagattttcaatggataccagttcgacattgttgtcgacaatcgcgttgtacgcttcacgcggggaccggtaggccggaataggcttcattcaaccgtgcgccagggttgttttctttcagccaggcaaacatggtgtcacccagatcgtgaatccctatgttcgcgtaagtgtcaggatattgttcaacaagttccggcatcacctgcgccagcggtgtgttggcatcatagtggcgtttgaaggagcaaagggtgttaaccagagtcccccatttcccacgggtcacgcccatagagaacaggaacataatctggaagtcagtggtacgggtaggcacaatgccgtggcgaccaagccaggctgtgaccagcgccgccggaacaccggtttcttccagttcaccatcttcacccattcccggagcaaggatgctgactttaatcgggtcgagcatactccagttatccggaatatctttgaagccgtgccagctttcgcccggatgcatgacccagcagtcctgaacggtggtcagcagtttggttggtgcgtcagcaaagtcataggttttgccggtttgtgggtcggtgacgacttctttgttccacggtttgaagaaccagctaccgtcagcggtgaactctttatacagccgcgccatcgcctgacggaaatcaaccgcttcgtcgatcacttcctgggtcagtgacaggccgctgttgccgtccatcatcgacactgccacgtcgttggatgcgcagatggcatacagcggggaggtggtggcatgcatcatgtaggcctggttgaagcgggagaagttaatcgccccacgaccttcacgtacatgaatataagaggcctgggacagcgcattcagcagtttgtgggtggagtgggtggcgaaaacggtaggaccgttgtgatcgccaggttcgccgcgcatggcatagtgatcggcatagatcgggttgaaacgtgcatagccgtaccaggcttcgtcaaagtgcagacgatcggaggttttttccagcagatcctgcgcttctttagcgttataacacacgccgtcataggtacagttggtcaccacgcagtaagacggtttttgcccgactttgtctttggtcagcgggctttcactgattttcttctgcaaggtttcaggttgcatttcctgcggatagattggcccgataatgccgtagcggttgcggcttggcaccatgtagaccggtttcgcgcctgtcagcatcaagccttgttcgatggatttatggcagttacggtcaacgaccacgacatcgttatcggtcatgcaagcctgcatgatggtgcggttagagccggaagtaccgacgactaccgaccaggagcgatcggcaccaaatacgcgtgcggcatatctttcgctttcgccaaatgcgccagtatggtcaagcaaagaaccgagggaagtgcgttcgatgcccatgtcggtgcggaacagattttcaccatagtagtcatggtagaaacgtccggcgggtgttttggtaaaaccaacgccgccctggtggcctggcgctgcccaggaatattcatggatgtcgctatatttcatcagcgcgctgaacagtggcggcaatagctgctggcggtagcgggtcatcgcggcaacggcgcgtccggcgataaagtcggcagtatcttccagaatccaggcgaattcatcgacaagctccagcaggtcgcgatccattgcggcgagggctttttcccgatcgcccaacaggaagaccggcacgttttgttggcgctcatgaagcttaccgatcaattgtctgacgttttgatgttcgtccggatgttccatttgatagctgaacatcaggcagtcaatggcttcgtttgaagagagaatggcaaaaccatcatcaaaggaggtggatttaatcacggtaacattttgctggcttaaagcatctgccagacgctcaacggcgttaccgacccaggtgtcttgatggagaaactcgctttcaacaattaatactttcatcattgcttacccggttatgaaggaatcttcgttgcgggcaagtatcttccggccttttcgggctgtaaagcgcgtgaaaaacaaacatttttgaaatatttatttttataaacaacacgttatgtgattattttaaattattttcactgcttattatcgacggctaaactatttttttggctgatactgatatcgtctttagccgggaaacgtctggcggcgctgttggctaagtttgcggtattgttgcggcgacatgccgacatatttgccgaacgtgctgtaaaaacggctactcgaacgaaagcctgccgtcagggcaatatcgagaatacttttatcggtatcgctcagtaacgcgcgaacgtggttgatgcgcatcgcggtaatgtactgtttcatcgtcaattgcatgacccgctggaatatccccattgcatagttggcgttaagtttgacgtgctcagccacatcgttgatggtcagcgcctgatcatagttttcggcaataaagcccagcatctggctgacataaaattgcgcatggcgcgagacgctgtttttgtgtgtgcgcgaggttttattgaccagaatcggttcccagccagagaggctaaatcgcttgagcatcaggccaatttcatcaatggcgagctggcgaatttgctcgttctgactgtttaattcctgctgccagcggcgcacttcaaacgggctaagttgctgtgtcgccagtgatttgatcaccatgccgtgagtgacgtggttaatcaggtctttatccagcggccaggagagaaacagatgcatcggcagattaaaaatcgccatgctctgacaggttccggtatctgttagttggtgcggtgtacaggcccagaacagcgtgatatgaccctgattgatattcactttttcattgttgatcaggtattccacatcgccatcgaaaggcacattcacttcgacctgaccatgccagtggctggtgggcatgatatgcggtgcgcgaaactcaatttccatccgctggtattctgaatacagcgacagtgggctacgggtctgcttttcgtcgctgctgcacataaacgtatctgtattcatggatgactctctttcctggaatatcagaattatggcaggagtgagggaggatgactgcgaacaggcgcacggttttattcctctccctggaggtgcgaggagagcggatgagaagatttgggtcgattattcagcttttcaggtaatttattcccataaactcagatctattgatgtgccacttaggatctgagttttcgggaatgctcaaccgggaaaccggaggttttctgcgatatcgcctgccatgatgaagttattcaagcaagccaggagatctgcatgatgtctgcacccaaaattacatttatcggcgctggttcgacgattttcgttaaaaatattcttggtgatgtgttccatcgagaggcgctgaaaacggcgcatattgccctgatggatatcgatcccacccgcctggaagagtcgcacattgtggtgcgtaagctgatggattcagcaggggccagcggcaaaatcacctgccacacccaacagaaagaagccttacaggatgctgattttgtggtggtggcatttcagattggcggttatgaaccttgcacggtgactgatttcgaggtctgtaagcggcatggtctggaacaaaccattgccgatacgctggggccgggcggcattatgcgtgcgctacgtaccattccgcacctgtggcagatttgcgaggacatgacggaagtctgccccgatgccaccatgctcaactacgttaatccaatggcgatgaatacctgggcgatgtatgcccgctatccgcatatcaagcaggtagggctgtgccattcggtgcagggaacggcggaagagctggcgcgtgacctcaatatcgacccggctacgctgcgttaccgttgcgcaggtatcaaccatatggcgttttacctggaactggagcgcaaaaccgccgacggcagttacgtgaatctctacccggaactgctggcggcttatgaagcagggcaggcaccgaagccaaatattcatggtaatactcgctgccagaatattgtgcgttacgaaatgttcaaaaagctgggctacttcgtcacagaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaacgcctcccggattgatattaaaccgtcacgggaatatgccagcacaatcatgaacgctatctggactggcgagccgagtgtgatttatggcaatgtccgtaacgatggcttgattgataacctgccacaaggatgttgcgtggaagtggcctgtctggttgatgctaatggcattcagccgaccaaagccggtacgctaccttcgcatctggccgccctgatgcaaaccaacatcaacgtacagacgctgctgacagaagctattcttacggaaaatcgcgaccgtgtttaccacgccgcgatgatggacccgcatactgccgccgtgctgggcattgacgaaatatatgctcttgttgacgacctgattgccgcccacggcgactggctgccaggctggttgcaccgttaaggggtaatcgcttccggcgctctggtgattaagccaaagcgccgtagctggcggcaatgaaagcgggcgaggaatatcaccgtcgttaatgcgcccagtagtgcgcagaacatatcggattgcgtatcccacgggtcgccttgagtaccgagaaaatcatctgcgccctggcccattgccagcgctgcccaccactcgattaactcatacatcgcgcttatcgccagcgcgacacaacagaccagaaacgccaccattttacgcccgcgaacgtacatcccgcgcacgaggatctctcgtgccaccagtgcaggcaccagcccctggaaaaaatgccccagtttatcatacggattacggctcaaccccagccattcctgcacctcaaaaccaacggggactttcgcgtaggtgtattgcccgccgaccatcaggatgatggcgtgaaagaaaatgagcgtatagagcagcggcgttaacgggtaacgtttagcggtggcaagcagtagcggcacgacaataatcaccggtgtcacttccatcagccaggtgagtttgtcatgggccgaaatgccggtataaatcaggattaacgttagcgccagtgcgccggtgttaagaattaacggcttgagtgtgcgggtcatggtgagttcgcaagtcagggaaaatactgactattgaccagtaagcgtgaaattacaatcgcaaaagaggtggcccagggggatcacctggcagcatgctgccaggcgctgggccgaagaggttacttagtgcagttcgcgcactgtttgttgacgatctgctggaagaagtcgttacctttgtcatcgaccaggataaacgccgggaaatcttctacttcgattttccagatagcttccatacccagctccggataagcgacgcattccagatgcttgatgctctgctgcgccagtaccgccgccggaccgccgatgctaccgaggtagaagccgccgtgtttatggcacgcgtcggtaacctgctggctgcggttacctttcgccagcatgatcatgctgccgccgtgggattgcagcagatccacgtaggagtccatacgacctgcggtggttgggccaagtgaacctgatggataaccggcaggcgttttcgccggacccgcgtagtagatcgggtgatctttgatgtactgcggcagttctttaccggcgtcaatcagctctttcagcttggcgtgtgcaatatcgcgacccacgataatggtgccggtgagcgacaagcgggtggataccgggtattgcgaaagctgggcaaggatctctttcatcgggcggttaaggtcgactttcactgcttcgccttcacctgcctgacgcagttcttctggaatgtactggcctggattgtgttccagtttttcgatccagataccttcgcggttgattttcgctttaatgttacggtcagcggagcaggagactcccatgcctaccgggcaggatgcgccgtgacgtggcagacggataacgcggatgtcgtgcgcgaagtatttaccgccaaactgcgcgccaagaccgagtttctgggcctcttccagcagttcctgttccagctggatatcgcggaacgcctgaccatgttcgttcccttccgtcggcagttcatcgtaatagtgagcgcttgctaacttgacggttttcaggttggtttccgcagacgtaccgccaatcacaaacgcgatatggtacggcgggcaggctgcagtaccgagggtacgcattttctcgacgaggaagtttttcagtttgccgggcgtcagcagggctttggtttcctggtagagatacgttttgttggcagagccgccgcctttagcgacacagaggaatttgtactcatcgccatctaccgcgtacaggtcgatttgcgcaggcaggttcgtgccggtgttgacctctttatacatgtccagcggcgcgttctgtgaatagcgcaggttatcttcgatataggtgttatagacgcctttcgacagcgcttcttcatcaccgccaccggtccacacgcgctgaccttttttaccgacgatgatcgcggtgccggtatcctggcaggtcggcagcacgcctttagcggcgatttcggagtttcttaagaattgcagcgccacgtacttgtcgttttcgctggcttctggatcgtgaagaatagccgcaacctgtttctggtgtgccgggcggagcatgaaagaagcgtcgtgaaaggcttgctgcgccagcagggtcagggcttctggttccactttcaggatggtttcgccgtcgaagtcggcaacgctaacgtaatcagaagtgagtagatagtattcggtattgtctttccccatcgggaaaggtgcctggtagataaagggtttgtttgacatagcttccagcctgtaactctgtatttgttattcgaaaatggcgtgccgcgtagtcacgggcggcacgcaaagtgcatttataagaacccgtacatcgcggcgaagatccagccgaagacgcacgatacgctcacaccaatcaaccccggcagaataaagctgtggttgatgacgaagcgaccgatgtgggtggtgccggaacggtcaaactgaatcgctgccagatcgctcggataagtcggcaggatgtaataaccgtagcaagccggtgctgaagccacgatgtatgccggatcaacgccgatcgccagcgcgaccggaacaatcgccgccagcgccgcagcctgagagtttacaaacttggaaaccagcagcagaacaatggcataggcccacggatactctttcaccatttcacccagtacgccctgaatttcagacatatgcgcaccgaacatggtttcagccatccatgcgataccgtacaccgccacgatggcgatcataccggaacggaagacttcgttttttgagatagacgcgggattggttttggtcaggataataatcagcgccccggtcagcagcataaacatctgaataaccagtaccatcgacagcggtttgccgccgaaggatggacgcaggtccgaatcagcaccaagaagggcgactacagcgattgccccgaggaagatccacattgccagccagttgcttttcggcagttttttatccagcagcgtcgcggtatcaccgtaaacatactcacggttttccggtacggagatgaatttttggaactcttcgtctttatccagatctttaccgcggaaccagctgaagataccgatcgccaggataccgattaacgtcgatggaatggtgattgccagcaggtcgaggaactcaagatggcgaccatcaaaggtgacattacccagcatcgcaaccaaagatacgaccgcaaccgacaccggactggcgataatccccatctgtgcaccgatagaacttgccgccatcggacgttccggacggatgttgttcttaatagcaacgtcgtagatgatcggcagaatggtgtaaaccacatgacccgtaccgcaaagaatggtcagcgtacaggtcacaaacggcgcgacaattgagacatatttcgggttgcgacgcagcagcttctcggcaatttgcagcatgacatcaagaccgcccgaagcttgcaaggtcgccgatgccgccaccaccgcaatgataaccagcatgacatcaaccggtggtttacctggctgaaggtggaagacgaagaccagaatgaccagaccgataccgcctaataaacccagcgcgatacccccctttctggcaccataaaacagacatatcagtattatgataagttggatagtaaataacatgtgtgaaccctcgcgataatcctatttaaatttttgctgaatagatcacagtcacgttctgttttgtatgaactgttttcagagcctgactaaatatccgtttggtcgttaccggcttgagcaaatacctcacagtgaatattggctgattaaagcagcggcaaatttatgcactgtgataagcggctttttcagagagaaagactctctggcgatgggtttatagtttgtacagcgcagatgttaatgttttgtttgctgttatcttattgatatttatcggtctgttttttgttctcagggcaggtatcattaggtttatagattaatctgatctacccatttgtgggtaaaaatacacataatgtgggtgacataatagttaattaacttttgttagcgttttgaaattaaaaacaccgttcatctgaagagatattaatttttagcgatgatggagggataattatatttgatctggcacaagttttactgatgaacgatgtaacttgtgccagggggattttgcattacggtaataattattacttacagataaccagcgatccgttattggcaatattgtttcagtagtgagtagtgttctgcctgaatacggtaacggtaaaccggacgccccgtgacgccataatggatactggtgaacaatatgtggcagttgaccagccagataaggtatttacggcaggaaacacgcgagatgttaacctcgttagccagctcgtcggttgaaaactcatagtcctgatgcgcgtcaatccactggcacagcgtgcgtaacgtctgcggcgttaagccttttggcaagcgacgaggatcctgctcgttggagctgctgccgtggattagctgatcaagctcggcctggtcataatactgatgtttttccagcgccattttcttttgccgccagccggtgagcgcctcttcaaagcgggaagcctggaagggtttgatcaggtaatccacaacaccgtaatgcagcgaatctttaatggttactgcatcggcagcggaggagatgacaatcacatcacttttgcaacgcgcgttatgcaggacaggcagtaaatcgagcccgttctctttttgcatatagatatctagcaatatcaggtcgataggcgtatcgctattgaagataatctctttggctttctccagcgtcgaagccgttccacagcattgaaagcccgggatttgtgccacgtatcggcgattcagctccgcgaccattgcgtcgtcatcgataattaatacattgatcatctgttcgacctctccccgtcccagggtatctggacaaaaaattgtgtgaaaatcccgggttccgattccacggcgatgctgccgccgagattttctacctgttgtttgacaagtgctaaaccgacgcctcgctcgcttccttttgtcgagacacctttgtcaaaaatgtgatcgattttgtcgggtgcgatccccggtccatcatcgttaacttcgcagtgcagccagccgtgacggtagtgcaatgttacgctaatttcgccaccgggttccggtcctaatgcctccagcgcgttttctatcagatttcccaacgtggtaatcagcgtcgcgacctgatcctcactaccgctgtctggcagctggctttcactgtttaaaatcagcgtatggcctaaatcggtcgcgcggttaatcttgctgattaaaaaaccagcgataaccggagatttgatcttacccagcagagagccaatctcttcctgatagttattggctgttttgagaatgtaatcttccaactgcttataactcttcagatgcaataatccgagaatcacatgcaatttattcataaattcgtgggatcgttcacgaagtgcgtcagcatagttgaccagaccgtcgagtcgctgcatcagtttacgtacttcagttttgtccctgaaggttgaaatggcaccgatgataacgccattactgcgcaccggaacggtgttgatcagtaatagtcggtccttaatcgtaatctcttcgtcgcggcgtggggttccgtcgcgtaacacttccgagacatctaccacctgtgaccacgagtggcttagcgtcgacagtttctcatcgtcctgcgacttacggtaattcagcaattcttgtgcggcatcgttgatcagcgtgacctcgccgcgatcgtccacggcaacgacgccttctttgatggactgcaacatggcctggcgttgctcaaacagtgtggagatttcgtagggttccaggccgaaaaggatttttttcagtacgttaaccagaatgcatgtgccgatcagtccgaccagcatgccaaatagtaccgaccagataatgctccagcgactgtcattgatctgttgggtcacgcggcttaactcaaggccgatcgccaccacgccaatttgtttatgattttcatcgtagatgggggtaaatacgcgtaaagcctgcgccagaaaaccgcgattgatagcgacattttcttcgccattcagcgctttaaggatgtcatcacctttaaatggctgaccaatacgctgggcttcaggatgcgagtagcgaaggctttgcatatcggtaacgacaataaacagcagatcgttgcgtttgcgcacggcttccgcgatggcctggattccactctcctgcggttttttctgcaagccctgacggatttccggcgagtcggcgagggtacgcgctactgccagtgccttgttagctagcccgtctcgcgtcatatcactgatttgcgagaagtaaatcagatgcaccaccaatagcaccgagaacagtaccgcgctgaccattaagatcacagtggtactcaatttcatcggacgtttgcgtaacatacggtagggcaatgaatgtctcatcagcttccttgtgtgacaaatttcttaagcattatctctgatgaggcgggtaattcaaagggagtaagaatgattggctatataggggaagagactctggcaacggaaactgccagtgctgtatgaagattccggggctatgcttatagcgataatcatactgatgagagagggaaggtcatggatcgggcgctactggacgggggttatcgctgttataccggcgaaaatatcgatgtctattttaacactgcgatatgtcagcattctggcaattgcgtacgtggcaacggcaagttatttaatctcaaacgaaagccgtggatcatgccggatgaagtcgacgttgccactgtggttaaagtgattgatacgtgcccgagtggcgcgctgaaataccgtcataaataagcgagggtaaaatggaaatacgcgaaggccacaataaattttacattaatgacgaacaaggcaagcaaatcgctgaaattgtctttgtgccgaccggagagaatttagcgattatcgaacataccgatgtcgatgaaagcctgaaagggcaagggattggtaaacagctggttgcgaaagtcgtggaaaaaatgcgtcgggaaaaacgaaaaattatcccactatgcccatttgcgaaacacgaatttgataaaacacgggagtatgatgatattcgcagttgatgggagagtacagagtcacgatatttttcatgctctccgcggtgtgatgcaggagagcatctgaagggtagggggatgcacaaagaatggtcagagagagcgtttttttgtcccaagtcatcccctttactgagcaaaaaaaaaagaatatctcctatatgagaatcatcattcggggttaataagttttgcgtccccagagcgttcaatattgataggagtcatattatggaaggtaaaaacaagttcaatacttatgttgtttcttttgattatccatcatcttattcctcagtgttcttaaggttaagatcattgatgtatgatatgaatttctcctctatcgtggctgatgaatatgggataccacgacaattgaatgaaaactccttcgcaataacgacatcgttagccgcaagtgaaatcgaagatttaatcaggctcaaatgcttagacttaccggatattgattttgacctcagcattatgacagttgatgactatttccgtcagttttacaagtagccaggaaggataagaagaacataaaaaatggcactattctctaaaatattaattttttatgtgattggtgtgaacatatcctttgtcattatctggtttatctcacatgagaaaacacatattcgtttacttagtgcatttctggtcggaataacctggccaatgagtcttcctgtggcattacttttttctctcttttaggagctgtagttgagtggacccgctggttatcttgaaacgaagcgtctctcctcaaaactggatttgcggaatgacgaacgaagcagtcgcctgactgcttcgttcattaaagtgaaatttatttctgtgggcgcatcgccgggaagagaataacgtcgcgaatagtatgactgtttgtaaacagcataatcattcggtcgataccaatacccagaccagcggttggcggcagaccatattccagcgcagtcacgtaatcttcgtcatagaacatggcttcgtcgtcacctgcagctttagcgttaacctgttcctggaaacgttcagcctgatcttctgcgtcgtttaattcgctaaaaccattaccgatttcacgaccaccgatgaagaattcaaaacggtcggtgatttccgggttaacatcattacggcgcgccagcggggacacttctgccggatattccgtaataaaggttggctgaatcagatgtgcttctgccacttcatcaaagatctccgtaacaatacgtcccagtccccagcttttctctaccgtaataccgatagattcagctaatgctttagcagcatcaaaattatccagatccgccatatcggtttctggacgatattttttgattgcttcgcgcatggtgagtttttcaaacggtttgccgaaatcaaacacatgctcgccataagtgactttagtggtacccagtacctcttgtgccagggtgcggaacagtgactccgtcagttcaatcaaatcgtggtaatccgcatatgccatgtagagttccatcattgtgaactcaggattatggcgaacagaaataccttcattacggaagttacggttgatttcgaatacccgttcaaaaccgcctacaaccagacgtttcagatacagctccggcgcgatacgcaggtacatatctaaatccagagcgttatgatgggtaataaacgggcgagcagatgccccacctggaattacctgcatcatcggggtttctacttccataaagccgcgcgcgaccatgaactgacggatagcggccagaatttttgaacggacaacaaacgtttgacgggatttatcgttagcgatgaggtccagataacgttgacgataacggacttcctgatcctgcagaccatggaatttatctggtaaaggacgtagtgctttagtcagcaggcgcagctcagtacagtgaatggaaagctcacccgtttgcgtcttaaacagcgtaccgcgggcaccgataatgtcacccagatcccattttttaaactgatcgttataaacaccttctggcaggctatctcttgcaacgtacagttgaatacggccaccgacatcctgcaacgttacaaaggaggctttccccataatacgacgggtcatcattcggccagcaaccgagacttcaatgtttaaggattccagttcctggttatccttcgcatcaaactcttcgtgcaactggtcagaggtatggtcgcggcgaaaatcattgggaaacgccacaccttgctgacgtagtgccgccagtttttcgcggcgatttctcagttcatcgttaaaatcaatagcctcattggctccccgtgtttctcgttcagacattttggttcctctaaatccagctttcaatttagcgtagataaagagacagatcggtacactgtattatctgcctcgactattaataactcagtttatcttatcgaaactaacgcttacctcaagttgatatcactaataaataaccataaaaatggtttaaatgacttattaatctcgatttgctagtgtgataaactgaaagttattttattcataaccaattgtttttacgacagttaatcgttgctctcctgtatcatattcgtcggcgtgctaaacagaaaacgggtagcaaaggccaataccacgatgatcgcgacacaagccaacgtccactctcccatctgagaaaagaatcgctggtaagcggcaattgccataccgctaatttgcgactctgtcgtctgctgtgccacgacgcctgccagccagttggcgactgcgcctgttgccagcatataaataccggttaatacgccagacattttcagacgcgtgatttgcgcaatcgccaccgggtcaataaagagttcagcaaagcccattagcgccagcccggatatcatcacgcccattgacgcttgaccgccagccgctgcatgtcgggcatcaaatgccagcaacataaagccacaagccatcagcagtaagccaaaggcaaacttcagccagacgcgcaatgctgaattgccgcggctttctggcgacgccagccaggccagaacaaccccagcgagcatcaccgcaatggcattcaccgactggaatagtgctgtaggtacttcaatattgaatgcctgacgattcacaaagcgatcgataaacaagctgatggtactgccgccctgttgtgccagtacccagaacaacgtcccgacaaacatcaacaatacaatttgccaaagagcacggcggtgttcggggaatttgatcatcatgcgggcaatgatttgtgcggcaatgaggcaaacgatcgccagcaaatatccggaccagtcgttctccagcagcagggtaaaaaatactggggctaaacagagcatcaccactaaccagctccatactggtaaggcaaatttgacgcttgtgagcgcttttttatccatactacgcgtggactggaaatgacgatgaccacttaagaaaatcaacaaaccgataaacatgccgcctcccgcaagggcaaagccaacatgccatccataccactgagcagccaggccgcaggcgatgggcgcggcgatagaaccgatattgcccgcagcatacagcagcgaaaaaccgccatcacgtcgatgatcgttctcgtcgtagagctcgccaagcaaacagctgatgtttgatttgaataaaccgtagccacaaataatgattgccagcgccagatacaggctaaaggttgaatttgtatcaatgcccagcaccacatggccaagggtcattaacagcgcgccggcaatcactgcagtgcggttgccgagcaggcggtcggcaagccagccgccgagaataggggtaacgtaaaccagagaagcatatgcgctgaacaggctgatggcatggttatcatcaaaaccaagctgatgggtgagatagagaatgagtaaggcacgcatgccgtaaaaactgaagtactcccagatttggatcgccacgatatagtatatcgcgcgcggctgtgagggtgttttcatgtgttctccttatgagcaaaaaagggaagtggcaagccacttcccttgtacgagctaattattttttgctttcttctttcaataccttaacggtatagcggccatcagcctgacggtatgcaccgtgaatatcggtttcaaagcccggatagtgagcgccgatttcacacagcatctgcaggaactccagaaccggacggctttcttcggtgatcatttcacccggcattaccagaggaactcccggcggatacggaaggatcatattggcgttaatacgacctaccatttcgtcgaggtaaacttcttcggtcataccgtgcagctctttctggaacgcagcatacggagtcattaccatagtcggcagaacttcaaatgcgcgatacatcagatccggcagattgtggtgaacaatcagtttgtggatattctgagccagttcctgaatacgcatgttttcatagaattcaggatcttcacgatacagagacggcagcatgtttttcacacgcaggttcagatcgaacgcacgtttgaagtcagtcagagcacgcagcaggctcagtgctttggtcttatcgataccgatgctgaacaggaacagcaggttatacggaccggttttctcaacaacgatgccatgttcgtcgaggtatttcgccacgatgctggccggaataccaaagtcgctcatggtgccgtctttttccatccccggagtcagcagggtgactttgatcgggtcaagatacatgtgctcgttatcgatgtttttgaagccgtgccaggtgctgtcagaacgcagcggccagcattcagtcgtatcgatatgatccggctgccatacatcaaagaaccagccatcagattccgttctcagacgtttgatctctttacggaatttgatcgcacgttcaatggaaccattgatcagacgtttacctgcattgcctttcatcatcgccgcagcggtttcagtggacgccacgataccgtagtgcggagaggtggtggtgtgcatcatgtaggcttcgttaaaggtttcttcgtttacgtcacctttaacgtggatcatggaagcctgagagaacgccgccagcagtttgtgagtagactgggtttcgtaaatcactttcccttctacacggccaccgctcataccgcatttaccttcgtaaatcggtgagaagttggtgtaaggcacccacgcggagtcaaagtggatggatttcacatccagtgttttcttgatgaagtcggtgttgtacagcagaccatcataggtagagttggtaattacagcatgtaccggccaggttgcgtttggtgtttctttcacgcgcttagcaatggtagcgtgctggaattcactctgtgggataccaccaagaataccgtaagcgttacgggtcgggcggaaatagattggcgtaacatcgctcatcatcatcaggtgggtcagcgatttgtggcagttacggtcaatcagaatggtgctgcctgccggagcagagtacataccaacaattttgttcgcagtggaagtaccgttggtcaccatgtagctgcggtctgcgttaaagacgcgagcgatatactgttctgcttctttgtgtggaccactgtgatccagcagagaacccaattcagatactgaaatggaaatatcagatttcatggtgttcggaccaaagaaatcatagaacaggctacctaccgggcttttctggaatgcagtaccacccatgtgaccaggagtacagaaagtatatttaccttcacgaacatatttaaacagtgctttggtcagcggaggcagaatagtgttgatatattcgtcagtggtctgcttgatcttgttagcaatatcatcagcagcacccagcgcatattcaaagaagctaatctgtaaacgcaggtcattcaggcttacatcgagagtggaatacgtattagcgaacgcgtacaacggcaggttctcgttcattttgctaatttcttcgcacagctcgagattatatttatcccagtcaaaaataacgccgcacagacgcgcattgttttcgatcagttttaataagtcgtcacggtcgttcgggtaaacaatctggaagttcagacgttcaagcgcgcgatgaagttcacggatgggttcttctttaaaataaacccccatgtgattcaatattgcaataacgttcatagtcatatctccaggtaaaaaaggcccctcccaacacatgggacaaaatgaaaggaggagcctcggaaaatacttttaattaatgtgcgttagacgctgtgtggttatccattgagtggctctggcgctcgtgcattttgcgagcgtagaacatcaggataatcaggctgacgatgaaggtacctgccagctcgaaggagcttgcgcccatcagcgcgatgaagcagaacacgcaacccagtacagagcagatcaggctgacaaagttgcggatgttaacgccttcaaaacgaatcaggtcaacgcaagagtagaagtacggcagcatagtcagcagtactgcgataccggtcagttcaccgaacaggtcagaggctttaccaccggcagagttcatcagagtgatgaggatcatcagggcagtcattttcactgcagccagcagcagaccttttttcggaataccgttgctgtcgacttcaccataaactttcgggaagttaccgtcgttagcggcacgtacacctgcctggcctaccaacatcatccaggagcccagagaagtcaggcacgcaaaggcggtgaatgcagaaaccagtggcgcagcccagttaccgaggatagttgaagcactgattgcaaacggagcaccggaagccgccattacagaagacggatacataccggaaagcacctgagtcgcagcgatgtaaacaatacctgctaaaccagtacccagcatggttgccagcggaacggtacgtttcgggtttttaaccataccagtacttactgctgcggattcaacacccacgaaggcccacaggcagagcagaatacttttaatgatcgcatgaccatcagtggtatccgcagtattccagttagctgcataagttgctgcatcaaaccaatgccagccaacaatagcagtcatcaccacaggaataagaaccagcaccagaccaatcgtggttaaacggcttacccaggtaccgccgagcatattcacaaaggtaaatacccagacgatagcaatacaggcgatacccgccggaacaggatcatttaatactgggaagaaggtggaaagataagatacagcggtaataccaattgccaggttaccaatccagttagcatggtaataaagaacacctgtctgaaaaccaaatgcaggggaaatttctccggcatacgcaattgggccaccttgttgcgggttttttgttgccagtcgggcatatacatatgccagcgacattgcaccaataatagagataatccaaccccagatagcaataccaccgatacttgctaggttcgcaggtaataatgcaataccgctccccatcatattaccggcaacaacaccggtacaggcaaatagcccgatcttcttggcagaactcatgctcttctcctaatttcatttttgaatttggagtccgggtcatgatgtataactatttcctgaccagaccaaactggcgctaagattactcacgaaaaaaggattaatcctaaagattaggtgaaataacacaaaagtttctgtaagtgagaacttgaggttttttattaacacatcaggatcgcaagttgatatcatgaaaagataaacattcaatgtttacaatgcattgcgtgacattctctggttaaatttatgtaataaaaattatgcggcaaataaattgccgcaacatattataccaacgggaacatacaaaaactcaacaacaaatattcccgagcatgaatcaacccgggagttacttattctgaagcgagaaatttgtcgagataaggtacaacataaggaacagaagtctggaatataccattttcaatccagtaaagggtgtttgcccctgggcgtaaattaaaggcggtgagatatgcatcagctgcttcccggttcatccccttcatttcataaaccttgccaagcaacacataatttagccaggacatttcaagatcaatgccggtatttatcgcctgataagactcatctgttttaccttttaccagggcactgaccgcttttatttgatatataatggacaggttgttcaattccggcagtgtaacaatgttatctatttctgtgttcagtgctgctaattgtttttcgtctaaaggatgttgagaatggcgcacgatatcaactaatgctttttctgctctcgcgtaggtaaattctggggatgattgaacaatctcacctaataattcactggcacgatccaatgatttatcatcaccatgcagtaaataatcatgtgcctgataaaaattagttaataacgcaccacgatgcggcaaaatttgctggagcatctcctgcattcgttgtggccacggttggtttaacgcttttgataaactctggagcaaatcattttgaatcgccagctgattaccgttagtgatgacataacgtttatccagcatggttgaaccatctgcattgtctaccaattttaccgacataaagcattgttgagcacggtattggcgctgattaacaaacgcaatagataatgttttaccggaactgctcggttcatcaatgttgtagttgattttgtcatgcaccataaaggtggagaaggtgttaagtgatgtcgccaccaaatcacccacgcctatcgcgtaagagagctgatacggagaactccagctgttacaactcttattaaccatattaatgtcaatatcgcgtggattgagcaaaatgcgcgatttactcataggaagacgtgtttcaagacttgaaaacgctaccagtgcgacacagatacctaacgacaacaggaaaaaaaaccatacccaaaaggtagtgaatcgtttgcttttaactggggattgttcaggtggcgttgtggtgttttgaatgttaagactgtgggagggagaatctgtggcaggaaccgcctctggtatagggggaggcgaagatagcattatttcctctccctcttcttcgctgtaccagataaccggcaccattaatttatagccgcgctttggtacagtagcgatatagacaggactatcttcatcattatcttttaatgacttacgtagttctgagatactctgcgtcacaacgtgattggtgacaatacttctcttccagacattatcgataagttcatccctgctaagtacttcgccactgtgttgagcaaagaaaaccagaagatcgattaatctcggctcaagggtaagttgacgcccattgcggctaatttggtttatggacggagtaacaagccattcgccaacgcgaactacaggttgttgcataatagaaactcattcgaaaagggaatgatgcaatgataattgccataacctattttttccatctatagatgggtttatttacatattattggtgaatgtaggacgttatttttacccgccataaacttcttgattacatagtattacgaaaggattttactgagaaccagaagtaattttccttaccatcaaaattcatcatctttgccaaagaaaaatgttcagaaaataatccatgaaaaattgtccggagcgcttactattttaatggattgttagtctttgcatgagcaaacggactgatacatttctctttgttctcattcagaaaatctcatcagttggcgttctgcccgatgttgtgctttatgggtgcgttacgctcctgatgacgtcatttgacgttcaacagcatcacggggccgcacgacatttcacgtcagtcagcgctatagctcagaaacaaattttcccgaattgggatatgcccgcaaattgctggtgatgtggggagaatctggttgagttcggtagaattgatttggcggcaggacgcttaaatcgtggcgtcctgaaacgaaaaacggacctccgtggaggtccgtttatatgaatttggtgcccggactcggaatcgaaccaaggacacggggattttcaatcccctgctctaccgactgagctatccgggcaacggggcgcattaaaccgtaatctgcacatctcgtcaacctaatttcagtaaaagcgattcaactgcttaagattgcggcaaatcgcttcttttctgtgtttctgtcaggtcagtgcaccaccctgacggcagcgggcgaagcgcaggatatcttccgccagccgatgtgcggtgtcgacatccgcctggctacgattcaccagcattcggcttaaacagccttccagcaccagttccatctgctttgctaccatcgccggatcgtcaacttccagcgtggttaacagttcgtgggtgaaatcgtaggccgcgcttttttgctgatcggccagttgatgaatagggtggccaggatcggggtaaaacgtacaggcagcgataaacagacagcccggatagcggttgtttttaacgcactccgataacgcctgataacgtgccagcaacttttgttcggcggtttgcgtttcgtccagcatcagctgacgacgccagacatctatctgttggctaagataacgcagcgcatcgtagaggattgcctctttgtctggccagaagcggcgtagctcgtccagtggataatccacacgttcagcaaccatctccagcgtggtgttggcaatcccttgtaattctaataatttcagggcttctcccagtacatcttcacgttgcacgctattttcctccgtctttcccactgcaagtgtcgttcacggttggcgatcgcgcaaatgtgcgctgaaggtttcagcatccataaagcccgtgacgcgtgcttgtggatgctcctggccttgtccgtcaaaaaagagaattgtcggtaggccaaggacattaagatgctttaacagcgccacatcttgtgcgtcgttggcagtgacgttggcctgaagtaagaccgtatctgctaacgctttttgcacctgcgggtcgctgaaggtgtatttctcaaactctttacaggcgacgcaccagtcggcatagagatctaacatcactggtttgcctttggcttcaacgagcgcctgatttaactcatctactgttttgatttgtgtaaagttgagatgcgtctgagtttgcgcggtatgtgtttcaccaaatgcccaatcctgaagtgggcgcacgctaaccaatgccgctgccagcaggattatttgcaccacgcgcatccagccgcgtttggcctgtaggctggtgataaaggcccagccaaagaatgcgacaccaagcgccgaccacaagcgtaatccccatatatcaccaatcactcgctccagcaggaagaccggcagtgcgaggatcacaaaaccaaacgcggttttgacttgttccatccacgggccgcttttcggcagcaagcggttaccaaagacggtaattagcatcagcggcaggcccatgcccagcgcataaagataaagcgtgccgccgcccagccacatgttcccgctttgggcgatatacagcagaatcgcgctaagcggtgcagtggtgcatggtgaacagatcagtccggcaatcgcccccataataaacacaccgccaggtgagccgccctgttggcgattgctcatcagcgtgagacgtgtttgcagcgaagaggggagttgcagagtaaacaagccaaacattgacatcgccagcaaggtaaagacgatggcgaggccaatgagcacgtatgggtgctgtagcgccgcctggaactgtaaccctgcggcggcaaccaccagacccagcgccgtgtaagtcagcgccatcccctgcacataaataaaggtcagcaacaatgctctggcagtggaaagccgctgtttaccgcccagcacgatgccagaaatcagtgggtacattggcagcacgcatggcgtaaaggcgataccaataccgatcaacaacgcccagagcgcggaaaagggcaattgcgcggtgggctgctcttgctgcggaacagacacaggctgtgacgcttcgttgttagcgaccacttcgcttaacggaacggttttggtttctggcggataacagaaaccggcatcagcacagccctggtaggtgacagttaacgttgctcccgcactcgcctggttgatggttacgggaagcgtcagccgatcgcggtaaatctcgcttttgccgtaaaactcatcttcatgccagacgccttgcggcagctgcacgtcagcaattttcgcgtgttccggcgtaatgcggatctgtttacggtagaggtagtaaccgtctttgatctgccaggtcagattcagatcatgttgattttgctgaaaatcaaaagcaaaggcttgatccgcggggacaaattgtgaacgtcccggcgcgtcgaataatccggcaaaaacggaagtgctgcaaagtagcaggatcagcgtaaagatgcgttgagccatgagaggtaatctgtgtctccgtgtgtaacaggtaaaaccagaagttccggggtttgatatggatgatgagacttcaggcattccagcagcgcctgctggtgagatacggtagtttttaaaatcatctgcacttcgtattcttgctccagcttaccttcccagtaatagagagaggtagcgccggggatcaaggtcgcgcaggccgccagtttttccgccagcactttggcggctaaatcctgggctgtcgcttcatccggtgccgtacatagcaccacgacagacgtggtattcgaacttttttcatcaagcataaacacctcgcaagaacagatggaaccgcaagagagaggtcactatacaacggacggggaaaggatgttagtcggcgggaaagaaagcggggcgtgaacgccccgcgatgggtcattacagcatgaagctacccagcacgaagccgaagcaaacggccagggcaacgcccagagtacccgggatgaagaacggatggttgaagacgaatttaccgatacgggtagtacccgtgtcatccatctgtaccgcagcaaccagtgtcgggtaggtcggcagaatgaacagaccagacaccgcagcgaaagaagcaacagcggtcagcggagaaacgttcagtgccagagccatcggcatcagtgcttttgcggttgcagcctgagagtacagcagagcagaagcaaagaagaagatgacggccagcagccacggatgaccctgaatcacttcaccagcggtatctttgatccagtcgatgttgttggaaacgaaagtatcgcccagccacgcaacacccaggatacaaatacaggcgctcatacctgctttgaaggtgctggagttgagaatgttgtcggtatcgactttacagataacggtggtcagagttgcaacgctgagcatgatgatcaggattgcgttggtggtgttcatcagcggtttttcaaccagacccatgcttgggctgttgatgattgcatagataaccacgccaactacgcccagcaggaacagccagacggacgtttttgcaccggatttgatttcaatctgcttttcaccgcgcagttcaaccaggccctcttccagacgcttgcgataaatcggatcgtcagagagtttggagttgaacagcatagtgaccaggaaggacatcaccagaaccgccagcagggtggacgggatgaccacggagagcagatggaggtagctgatgccatgaccttccattacggaagacatgtaaaccactgccgctgagattggcgatgcggtgatcgcaatctgcgcggataccactgcagtagacagcggacggcaaggtttaacgccttgttccttcgcaacttcagcgataactggcagtgtcgccagagagatgttgccagtaccagcaaagattgtcaggaaataggtcacgatcggtgcgaggatcgtgatgtatttcgggttacggcgcagcagcttttctgtctgatgaaccagatagtccagaccgccagcaacctgcatggcagaaatagcggcgataaccgccatgataatggaaatgacatcgaacgggatgttaccgggtttaacgccaatagcggcaagaaccagcacccccaatccgcctgcaaaaccaatacctattccccccaatctggcgcccaagaagatcgccagcaaaactatgatgagttctacaactagcatattagccttccttgttttttaacaagttgatattaaatcgttatttttaagttactactcacaagaaaaaaggcacgccatctgacgtgccttctttatttgtactaccctgtacgattactgttcgctttcatcagtatagcgttttgctttgtaagccgggtgcatcagattctgtacggagaaaatatcgtcaagttccgcttcagtcaacagaccgcgttccagaacgacttcacgtacactcttaccggtttcggcacagattttacccacgatgtcaccgttgtggtgaccgatgaacgggttcaggtaagtaacgataccgatagagttgtaaacgtaaccttcgcacacttctttgttagcagtgatgccgttaatgcatttttccagcaggttgtagcaagcgttggtcagaatgtgaacggattcgaacatggcctggccaatgactggctccataacgttcaactgcagctgacctgcttctgctgccatggtaacagtggtgtcgttaccgatgactttgaagcatacctggttaaccacttccggaacaaccgggtttactttagctggcatgatggaagagcctgcctgcagttccggcaggttgatctcgttcaggccggcacgtggaccagaagagagcaagcgcaggtcgttacagattttggacatcttcacagccaggcgtttcagcgcgccgtgaaccataacataagcgccgcagtcggaggtcgcttcgatcaggtcttcagccggtacgcatgggaagccagtgacttcagccagttttttcactgccagcggagagtactctttcggcgtgttcagaccagtaccgattgctgttgcgccaaggttaacttccagcagcagttcagcggtacgttggatatttttcacttcttctttcagcaagatgctgaaggcgcggaattcctgaccgagggtcatcggtactgcgtcctgcagctgggtacgacccattttcaggatgtcctggaattcgacagctttacgttcaaagccttcacgcagttggttaatcgcatctaccagtttaatcagggaagagtaaactgcgatacggaaaccggtcgggtaggcgtcgttagtggactgacatttgttaacatggtcgttcgggttcaggtactgatattcacctttctggtgacccatcagttccagaccgatattggccagcacttcgttggtgttcatgtttacggaagtacctgcgccgccctggtagacgtctaccgggaactgatccatgcattttccgttgttcaggacttcatcacatgcggcaatgatggcattcgctacacttttaggaatggtttgcagctctttgtttgccatagctgcggcttttttaaccattaccataccgcgaacaaattcaggaatatcactgattttgttgttgctgatatagaagttttcaatcgctctcagagtgtgaacaccatagtaggcatcagctggaacttccctggtacccaacagatcttcttcgatacgaatgttgtttgacatgtgaaccttctttttcaagctgccaatgatttgctttaaacacacagaatatatgtggtttcgaatgtttttcggccgacgattatcccctgcatcgaccgaatacccgagatcatatgctgcttgaggatttctaccgtaacctggatcactttaagtgtcggtttttaccccttaattattaatttgtgaaatggatcaccgctttgggattactaccaaaaatagttgcgcaaacatcttgaaattttgctaatgaccacaatataagctaaacgcgattcgcaacccattcaggtagccgggtttaaccggctgctattacaggagaaacctttgcgctggttaccttttattgccattttcctttatgtctatattgagatttcaatctttattcaggttgctcatgtattgggggtattgctgaccctcgtgctggttatattcacgtcagttatcggtatgtcactggtacgcaaccagggctttaagaatttcgtgctgatgcagcaaaaaatggcggcgggtgaaaacccagcggcggagatgattaaaagtgtttcgctgatcattgccggtttgctgcttttattaccgggctttttcaccgacttcctcggtcttctgcttttattgccgccggtgcaaaagcatctgacagtgaagttgatgcctcatctgcgtttttcccgtatgccaggcggcggttttagcgccgggaccggtagcggtaatacttttgatggtgagtaccagcgaaaggatgatgaccgcgaccgccttgatcataaagacgatcgccaggattaatgtcgaaacgccggattatgtggttatgccatttcccggcgtttttcgttttggcagaaacagccataaccccgccagcatgatcagcgcgtagagacttttccagccgaccattgccagtaacagaacgcataatagcccgccaaccactgccagtagtcgataacgtccttgcaataatttacagcctgccagcatgcataacagataaatcataataaagatgccattggcataaataataagagcgtccagattgatctctaaagcatgaatcaccaacgtgctcaccacgcagcagccgagcaccgcattgagggcattattcggaatatggcgagaagagaggcgtgccaggtagtggtcaggattatgttgcgcctgcgaccagaccaggcgggcgaagctctgtatataaatgttgagactggcaaagcaggccagatagccaattacgcaggcaatccataacgctcctacaccgaacaactgcactacaattttgggaagcgatgctgccgccgccatttgttcaccataggcgtcgaagtgtaagacgactaccgtacagccccaatagactaatcctgccagcagcaggccaatcatcaaagcacgaggaaaatcacgctctggatttttaaattccgaggcaagatgggcaaatgcttccagaccgacaaaacaccagaacatcactgataacgcagcgaataacccggtaagttcgatatttcctggcgcagggaaggggatattcgcaggtttgatatcgcccgcccaccagatagcgacaatcagtgcgacgataagtccggcaataactgtttgtagattagcactggaactggcaccgcgagtaccgatataccacaccagcgccagcgtaccgagttctgccaacaacagttgctcgctatgccagccaaacattgcctggccgaatccggcagcaatttgtagcgcggcaggcaaacccacgggaatgaccgataaaaacaaccagccggtgactcgctcaagccgcgaaccaaacgccataccgacgaagtgtgcgacgccgcctgcgctgggatagtggcgacccagaatcgcaaacacaatcgcaatcgggaacactaagataatcaaaacgggccacgcccacaggctgttattgcctgctactagcgcagctaacgcaggaacggcaaacacgccagtgcctaataatgacgtcgatagcaggccgatgccctgggccagccccagttcttgtttgagtccactcatgggttgatgtccgattgcgcccaaattttgggcaactgcgtagattttcgatggtagcacaatcagattcgcttatgacggtgatgaagaaatagcgatgaaatgtgaggtgaatcagggttttcacccgattttgtgctgatcagaattttttttctttttcccccttgaaggggcgaagcctcatccccatttctctggtcaccagccgggaaaccacgtaagctccggcgtcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatccgcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccgaaaggccgtaacgtagttctggataaatctttcggtgcaccgaccatcaccaaagatggtgtttccgttgctcgtgaaatcgaactggaagacaagttcgaaaacatgggtgcgcagatggtgaaagaagttgcctctaaagcgaacgacgctgcaggcgacggtaccaccactgcaaccgtactggctcaggctatcatcactgagggtctgaaagctgttgctgcgggcatgaacccgatggacctgaaacgtggtatcgacaaagcagttaccgctgcagttgaagaactgaaagcgctgtccgtaccgtgctctgactctaaagcgattgctcaggttggtaccatctctgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgttggctgacaagaaaatctccaacatccgcgaaatgctgccggttctggaagctgttgccaaagcaggtaaaccgctgctgatcatcgctgaagatgttgaaggcgaagcactggcaactctggttgttaacaccatgcgtggcatcgtgaaagttgctgcggttaaagctccgggcttcggcgatcgtcgtaaagctatgctgcaggatatcgcaaccctgactggcggtaccgtaatctctgaagagatcggtatggagctggaaaaagcaaccctggaagacctgggtcaggctaaacgtgttgtgatcaacaaagacaccaccaccatcatcgatggcgtgggtgaagaagctgcaatccagggccgtgttgctcagatccgtcagcagattgaagaagcaacttctgactacgaccgtgaaaaactgcaggagcgcgtagcgaaactggcaggcggcgttgcagttatcaaagttggtgctgctaccgaagttgaaatgaaagagaaaaaagcacgcgttgaagacgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtcctgaactgcggcgaagaaccgtctgttgttgctaacaccgttaaaggcggcgacggcaactacggttacaacgcagcaactgaagaatacggcaacatgatcgatatgggtatcctggatccaaccaaagtaacccgttctgctctgcagtacgcggcttctgtggctggcctgatgatcaccaccgagtgcatggttaccgacctgccgaaaaacgatgcagctgacttaggcgctgctggcggtatgggcggcatgggtggcatgggcggcatgatgtaattgccctgcacctcgcagaaataaacaaacccccgggcagaaatgtctgggggtttttcttttggtcatctttctagtataagattcagacacggacgacgcgagtggcgtccagctcattgattatggggaataacatgcacgtaaaatacttagcagggattgtcggtgccgcgctactgatggcgggttgtagctccagcaacgaattgagtgctgccggtcagagtgtacgcattgtggacgagcaaccaggtgcagagtgccagctgattggtactgcgacaggtaagcaaagcaactggctttccgggcaacacggagaagaaggcggttctatgcgcggcgcagcaaacgatctgcgcaaccaggcggctgcaatgggcggtaacgtgatttatggcatcagcagcccgtcgcagggaatgttgtccagttttgtcccgacggatagccagattatcggtcaggtttataagtgcccgaactgatgtgatccagaggctggatacttccagcctcgtagtaaaacagatgagattatttcgcctgtggtgcagttttgctggtggattgaacacgtaagtgatgcagcgcgcgtaagcattgatcctgggttagcggttgggcgttatttgccgctacggtgcgaacatagacctgacatggcacacccgcgagttttttcagtcgggggctgaaatcaagcattcggcgagtgatcgcctccacttctttacccggcgttgcttcacgcgttttcaccactgcgccgctaaattgttcattgccactttcatctttaaagcggtaaagcaccgccagataatggttgaacaagttatgtttccattccggttgggaataggtgtcatattccagattgccattttcctggcagtcaacgtcgtataacggcaggaaatctaacagtgaggtaatacgtaatgccagttcacgcatttccgcattattaattgcatgaatgattgctcgcgccagcatttcaatctgcaactcattgacgactaactcacatttgctaccgtcatgtagcgttaatacgaaggtaagattttcgccctgatcatcggtaagttccagcgtgttaacccgacgattaatatcggcatttttaagctcatcaaccagaatttctgggatattttctgccattttcttaatgactttatcgcgagcttgttcatactgaaggcgtgcagcagcatccagtttatgcttttgatgcagacgactttccagcgcaatcagaaggtcgcgcaattccatggcagacataaagaacaacgattctttattgcgaggttctttaattttcagcgccagtgcaatgaaattattactcttgcgaataacaccggtattaacacccttgatgcttatggccatgtaggttctccctaaccatttctcaattaaataattaattttagtttataagccagataaatgggcttggtagtaatagttgttaaaataacataaatagccgtgctcactctatataaacagaaaagaaaggttaattattggtgttggttatataaagagtaacaacagcaatgtatatgaataattaaaggttatgcaacgggcaaagattaaacttccctgtttaatcagttactgctggcgtagctggagatccagcggcgttttgctgggttcgccgccaatttctcgcgccagtttaggcaccagatatcccgacaccagtgtcagcaactcacgcataatctgccgtgcttcgtcatcactcaccataaaatgcgccgcgccctgtactttatcgagcacatgcaggtaatacggcatcacgcccgcatcgaacaacgcattactcaggtttgccagcgtttgcgcgttatcgttcacaccacgtaacagaacgctctggttcagcaaagtaacgcccacccggcgcaacttagccatcgcctgacggaatgtttcatctacctcattggcatggttgatgtgattcaccagcaagatttgcagcgtagaatgagaaaagcgttcaaccagcgcatctgtgatgcgtgccgggatcacaatcggcagacggctgtgaatccgcagacgtttgatatgcgggatggcttccagttgtgtgagcaaccagtccagctcgtgatctttcgccatcagcggatcgccgccggagaaaatcatctcgtccagttccggatgcgcagcaacatactcaagtgcagtctgccagttacgcttattgccctgattttcggcataggggaagtggcgacggaagcaatagcggcaatttaccgcgcagccgcctttgaccagcaaaagcgcccggttgtggtatttatgcaacaaaccaggcactacgctatgctgttcttccagcgggtcggtggagaatccgggcgcgacgacaaactcatcttgcgaggtaagtacctgacgcaaaagcggatcgttcggattgcctttctccatgcgatcgataaatgagcggggcacacgcagggcaaacagctttttggcgctgcgtccggccaacagtttttcgtccgcgtctatattcaaaagacgcagaagttcatcaggatcggtcacaacatcggcaagttgcgttaaccaatcttctctggatggggtatttagggttacaatatgcgccattttgtggcttagctaccaattaacaaatttcagagggccttatggcaacgtactatagcaacgattttcgtgctggtcttaaaatcatgttagacggcgaaccttacgcggttgaagcgagtgaattcgtaaaaccgggtaaaggccaggcatttgctcgcgttaaactgcgtcgtctgctgaccggtactcgcgtagaaaaaaccttcaaatctactgattccgctgaaggcgctgatgttgtcgatatgaacctgacttacctgtacaacgacggtgagttctggcacttcatgaacaacgaaactttcgagcagctgtctgctgacgcaaaagcaattggcgacaacgctaaatggttgctggatcaggcagagtgtatcgtaactctgtggaatggtcagccgatctccgttactccgccgaacttcgttgaactggaaatcgttgataccgatccgggcctgaaaggtgataccgcaggtactggcggcaaaccggctaccctgtctactggcgctgtggttaaagttccgctgtttgtacaaatcggcgaagtcatcaaagtggatacccgctctggtgaatacgtctctcgcgtgaagtaatgcggttgtggtgcggcctgcaggctgcaccatcacttattcaggtcagagatgatgaaacgccttatcgttcttgttttgcttgccagcacgctgcttacgggctgtaacaccgctcgcggtttcggcgaagatatcaaacacctcggcaactccatctcccgcgctgccagctaatttttcttctcttccgaaaaatcatcagatttccatcatttttggcgatgttgtctattattaatttgctataggcaaacataaataacattacctaaaaggaagacgttatggtgaagaagacaattgcagcgatcttttctgttctggtgctttcaacagtattaactgcctgcaacaccacgcgtggcgttggtgaagacatttctgatggcggtaacgcgatttctggcgcagcaacgaaagcgcagcaataagcaataacggtacgacagctgtgtcgtgccgtttgttttttctgcgatagttacataggtaatagttgaaattcccctgccacctggcaaaatatccgttcaaccatcagctttgcaggacgacctgcaaacgcgtcttttcaccggggacggccccaattttccggagcctgatatgtcctggattatcttagttattgctggtctgctggaagtggtatgggccgttggcctgaaatatactcacggctttagtcgtttgacgccaagtgttattaccgtgacggcgatgattgtcagtctggcgctacttgcctgggcgatgaaatcgttaccagtagggacggcttatgccgtgtggacgggtattggcgcagtcggcgcggccatcaccggcattgtgctgctcggtgagtccgctaacccgatgcgcctggcgagtctggcgttaatcgtattggggattattggtctgaaactcagcactcattaactaccgggctgctgtacccaaataaacttactgacatcaaacccttcccgggtcgcgactgccagcatctcctgtttcacttcgtcagaaatggttggcgtgcgggagagtatccacaggtagtcgcggtccgggccgcaaaccagcgcatggcggtattcccgatcgagtgcaataacgttataaccgccatagaaaggaccaaagaatgacactttcagcgcagcgcgagttggtgctccggtaaagtacgctttcccttcactctgctgccacatttctctgtcagggttatagcctttattaatgacattcaggccgccgtcatcacgcaggctgtatgttgcggtgactttttccagtccacgttcaaagcggtgatcaaaacgggcaatctcataccaggtaccgagataacgtttagcgtcgaaattattcactacggtcacgccacgcggcggcgtaggggaactgcaggcaacgaccagaaatgcagctgtcgctgcggcaacgagagggagcaggcgcataaatgtttccttactggtttttttctaagtgtagatgacagcaaggaaaagcggagaaaaggtccgaaaattcggacccgatgaaattttactgtagagtgttgagaatctgccaggcggcggtaactctcgctggattgggatagtttttgttagccagcatcacgatacccagctctttttctggaataaacgcgacatagctaccaaatccgccggtcgcccccgttttatgtacccatgatgcgcgtactgcaggagttgggggcgtaatcggttttacggggcgtgctgccagtgcaattttattgtcactgccgttaatgatgatgtcaggatttaccggccagtccagcatttcccagcccagaccctgatacatatcgccggtttgccagtagcgagattgtgccagctgtatcccttgttgaagtattttctcattgatatcaaagggttttaaattgctttgcacccagcgggccatatcttcaatggtcgacttcacaccataagcttcagcatctaacgcccctggcgaaacatgtactgccttaccttcgcgatatccccaggcgtagttcttttcttctgcggacggtacattaatccacgtatgattgagtttgagtggctggaagacacgagttttcatcgcctgctcaaaactcaaaccagacggcttcacagccagtgcgccgaacaaaccgatactggagttggcatacagacgttgtgttcctggagcccatgcaggctgccagttttgatagaagcgcagcaagtcgcttgaggatttcacctcatccggcacctgcaatggcaggccgccagcggtgtaggttgcgagatgtaatagtgtgatcccattccactgtttagcggtaagttcaggccagtattttgttgtgggatcgcttaacttgatttcccctcgagcaatagcgtcgccaccaagcacgcccgtaaatgttttgctgaccgaacctaactcaaacaacgtttgctgtgtgacgggctgctttttggcgatgtccgcatagccccaggtaaagtaataaggtttaccctgataaattaccgctaccgccataccggggatcttttgttgctctataagcggggtaattgtgcgatgcacaatatcgttgatttgttgaggtgcggcaaatgtggagcaagaggcggtaattaataaggtgcagagcgtcgttttgaacatagggtctggtttccatacaaaacggcccgccataggcgggccagatttacattggcgatgcgttagattgtaacgacaccaatcagtgtgacaactgtcaggatagcagccagaccgtagaaaacccatttacccgcaggtacgtggattttcagatcgtgcatcgcgtggtgcatacggtgtaaaccacaccacagcggcagaacgatcatcaggaacaggaatacgcgaccaatgaagctctgcgcgaacgccagaacgcgctcgtagctcagtgcatcacccggaaacagccctagcggcagcagaataccaaccagcaggatcatcaccggcgcaatgatggcgctccacataccaccggccccgaagaggccccagaataccggttcgtcagaacgctttggatttggattaatcatctcaggctccttaccagtacagggcaacaaacaggattacgatggtggcaaccacagttaccgcccagagacttttgataattggctctggtcccattttttcgtcttttacaatgatattggctgcttttggtgccagctcaaaccaggttttggtgtgcagcagggctgccgccagagtgatcaggttaatgatcacgataaccgggttttgtaaaaagtcgacgaatcccgcccaggcttccgggccatttttcagggcaaacagcccgaaaatcagttcaatgctgaaccacacagccggaaccgccgtgccttcgcgcagcatgtaaaagcgataaaacggcaattttttccaccaggtggacgtcattggccgtacatacggtttacgtttagtcgtcatgttgcactccttagcgtggtttcagggtcgcgataagaaagtctttcgaactttctactttgccctgctgaatggccgcagccggatcgacgtgtttcgggcagacttcggagcagtagcccacgaaagtacagctccatacgccgttctggctgttcaactgcgccatacgctccttcttaccgtggtcgcggctatcttcgttataacgatgcgccagcgtaatggcagccggaccgatgaactctgggttcaggccaaactgcgggcacgcggcgtagcacagaccacagttgatgcaaccggagaactggtgatacttcgccatctgcgccggggtctggatgttagtaccctgatccgcggtgcgggcgttgccgatgatgtacggtttgatcgcttccagactttcgatgaagtgggtcatatcgaccaccagatcgcgttcaatcgggaagttagctaacgcttcaaccttcataccgtcggtgtaatcacgcaggaaggttttacatgccagttttggcacgttgttaaccatcatgccgcaggagccacaaatcgccatacggcaggaccagcggtagctcaggtccggtgccaggttgtctttgatgtagcccagcgcatccagtaatgaggtagttgcgtcataaggcacttcatagaatgcgctatgcggtgcggtatcgacttccgggttatagcgcaccacctcaattttcaggtttttcatctcagccattcgccttctccttcttattggctgcttccgccttatcggctgcatccgcttcgccaccgtaaacacgtttagctggcggcagcgtagtaatcttcacgtcgctgtactccaggcgagtcgtgccatcagcatcgcggaaggcgagggtgtgtttgaggaagttgacgtcgtcacgctcggtgcaaccttcgtccagacgctggtgcgcgccgcgggactctttacgtgccattgcggagtgcgccatacattcagcaacgttcagaccgtggcccagctcaatggtgtagagcaggtcggtgttgaacacgctggaagtgtcggtgatgcgcacgcgcttgaagcgttcctgcagctctgccagcttgtcgatggttttctgcatcagttccggcgtacggtagataccgcagccttcttccatggccatgcccatttcgtcgcggatcttagcccagttttcgccgccatcctggttaaccagatctttcagacgttgttcaacgccagctgcctgcgcttcaattgccgcttcgttgccattaccggcagttgctgcacgctctgtcgcttgttcaccggccagacgaccgaagaccaccagttccgccagcgagttggagcccagacggttcgcaccgtgcagaccaacagaggaacattcacccacggcgaacagacctttaatgcgggtttcacagttctgatcggtttcgataccgcccatggtgtagtgtgcggtcggacgtaccggaatcggttctttaaccggatcgacgccaacgtacgctttcgccagttcgcagatgaacggcagacgttcatgcagttttttctcgccgaggtgacgcaggtcgaggtaaaccacatcgccacgtggcgtggagatggtgttgcctttacgccattcgtgccagaaggcctgagaaactttgtcgcgtggacccagttccatatatttgtttttcggctcgcccagcggagtttccgggcccatgccgtaatcttgcagataacggtagccatttttgttgaccagaataccaccttcaccgcggcagccttcggtcatcaggataccggaacctggtagaccggttgggtgatactgaacgaattccatgtcacgcagcggaacgccgtggcttagcgccatacccataccgtcaccggtaacgatgccgccgttggtgttgtaacgataaacgcgacccgcaccgccggtagccataacgaccgcgttagcacggatctgcaccagcgtgccttccatcatgttcattgctaccaggccgcgaacatgaccatcatcaaccagaatatccagcacgaaatgttcgtcaaaacgctggatctgcgggaattgcagagaggtctggaacagcgtgtgcagcatatggaagccggtcttatcggcggcgaaccaggtacgctcgattttcatgccgccgaagcgacgtacgttgacgctaccatccggacgacggctccatgggcacccccacagttccagttgggtcatttcggttgggcagtggtggacgaaataatccacgacatcctgctcacacaaccagtcgccacccgctactgtatcgtgaaagtgatattcgaagctgtcatgatcctgcgcgacagcggcggagcccccttctgcagcaacggtatggctacgcatcgggtatacttttgagattagtgcgatttttgcatttggatttgcctgcgcggcagcaattgcagcacgtaatcccgcgccaccggcgcctacaatggcaagatcggcttgaaaggtttgcacgacattcctccagattgtttttatcccacagccccgtacttcagggtaagtgcctgaaagttacggtctgcgaacgctattccactgctcctttataggtaaaacagtatagtctgatggataggtctgaaatttgacgagatcgatttttttagtgcgcaagagggctaaattatcactgaagatgattaatttaattactaaaccatcagatcgtgctttttttagtcactgcccaccgttgttttattcctgcgtaaaatttgtctcgccgtcgcgttgcgagtagacttcgtgcccttgtcaaaaactggagatttaactatgagcgaaacggcatcctggcagccgagcgcatccattcctaacttattaaaacgcgcggcgattatggcggagatccgtcgtttctttgccgatcgtggagtgctggaggtggagacgccttgtatgagccaggcgacggtaaccgatattcatttggtcccgtttgagacacgtttcgttggccccgggcattcgcaggggatgaatctctggttaatgaccagcccggaataccatatgaagcgcctgctggttgccggttgtgggccggtattccagctgtgccgcagcttccgtaatgaagagatggggcgttatcacaaccctgagttcactatgcttgagtggtatcgaccgcactatgatatgtaccggttgatgaacgaggtggacgatctcttgcaacaggtgctggactgtccggcagcagaaagcctttcttatcaacaagctttcttgcgttatctggaaattgacccactatctgccgacaaaacgcaactgcgggaagtggcagcgaaactggatttgagcaacgttgccgatactgaagaagaccgcgacacgcttctacaattgctgtttacctttggcgtagagccaaatattggcaaagaaaaaccgacctttgtgtaccactttccagccagccaggcatcactggcgcaaatcagtaccgaagatcatcgggtcgctgaacgctttgaggtttattataaaggtattgagctggcgaatggtttccatgaattgacggatgcccgtgagcagcaacaacgctttgaacaagataaccgtaagcgcgcggcgcgcggtttgccgcagcaccccattgaccagaatctgattgaagccttgaaagtcggtatgcctgactgctccggcgtggcattaggtgttgatcgtctggtgatgttggcgctgggcgcggagacactggctgaagtcatcgcctttagcgttgaccgggcataattctgaaaaattactgaattaacagcgaagaatggcgtgataagcgccattctgtagcatatgttttcatttttccgctaaaggccacaatttaagactggatatttgatatcatccaggtatcaattctgtattggtttttacgctgcccgctcaatgttgggcagtgcagttcagtgggcgcgttttatacacgcgctgaaatgaaggatggtttcatgcctcactcgataaaaaagatgagtctgataggactcatattgatgatctttacttctgtatttggatttgccaatagcccatcggcttattacttaatgggttatagtgcgattcccttttatatattttctgcattgttattctttattccattcgccttaatgatggctgaaatgggagctgcttatcgcaaagaagaaggcggtatctattcctggatgaataatagtgtcggaccacgttttgccttcattggtacgtttatgtggttttcctcttatatcatctggatggtgagtacctccgcgaaagtttgggtaccgttctcaacattcctctacggtagcgacatgacccagcactggcatattgccggactggagcctacgcaggtggttggtctgctggcagtggcatggatgattctggtcaccgtcgttgcttcaaaagggattaataaaattgcccgcattactgcggtgggcggtattgcagtaatgtgtctgaatttagtattgctgttagtaagcattactattttgttattaaatggtgggcatttcgcgcaggatattaatttccttgcatcaccgaacccaggttatcagtccggtctggcaatgctatcgtttgtggtatttgccatttttgcctatggcggaattgaagcggttggtggtctagttgataaaacggaaaatccagaaaagaactttgccaaaggtattgtttttgccgctattgttatttcaatcggttattcgctggcaatatttttatggggcgtcagcacaaactggcagcaggtattaagtaatggttccgttaacctcggcaatattacctatgtgctgatgaagagcctcggggtgacgctgggtaacgcactgcatttgtcacctgaagcgtcattgtcgctgggcgtatggtttgcgcgtattaccggactgtcgatgttcctcgcttataccggtgcgttctttacactttgctattcaccgctgaaagccatcatccaggggacgccgaaagcattgtggccggaaccgatgacgcgcctgaatgcgatggggatgccgtctatcgccatgtggatgcagtgtgggttggttactgtcttcatcctgctggtttcgtttggtggcggtaccgcatcggcgttctttaacaagctgacgctgatggcgaacgtgtctatgacgcttccttacctgttcctcgcgctggctttcccattttttaaagcacgtcaggatctcgacagaccgtttgtgattttcaaaacgcatatgtcggcaatgattgcaacagtggttgtcgtactggtggtgacatttgcgaacgtcttcaccatcattcaacctgtggttgaagctggagactgggacagcacattgtggatgattggcggccctgtcttcttctcgctgttagcgatggcgatttaccagaactattgcagtcgcatggcgaacaaacctgagttagctctcgactgatcatatgaaatcctgcaactcatcgtctctccggcgatgagttgtctggaaaggaagacgttatggacgacgctagtcgggatccagtgataaccgaagatgaaatcagggagctgcaattttctgccggggatgtggcggaaatagagcaaacggtcctctcttttgtcgatacccgccacacccgcaaagtagcgatggtggtgggtaacactattaataccctcaaagagcgcgatggtccgcggtggggaaacctgccggatatctattgcgcttatcttattagatgtctggtttttcgcggagaattagtgggatacggcgatttgtttcgtatgcgctatagcgaaattaagcgaccgattatctcatgagtgcgcgcatgtttatcttgtgctgcatctggtttattgtggcgttcctctggataaccatcacttccgcgctggacaaagagtggatgattgatggacgcgggattaataacgtctgcgatgtgctgatgtatctcgaagatgacgatacccgtgatgtcggtgtgataatgacgttaccgctctttttcccttttctctggttcgctttgtggcgaaaaaaacgcggctggtttatgtacgccaccgcgctggctattttcggctattggctgtggcagttttttctgcgctatcagttttgcttataagccggatgggttcatccggccacaaagaccttacaaacttcccgcctgacgacctttgcccgcagaagttaatgttctccccgtttgtttaccgttgaggctttccagacgcatctggaagggcgggaatggcatatcgataccgtgggcgtggaagcccgccagaattagttggtggatctcatggcgtagcggcatacggtgacccatctcagcggcgtaaatacgcagctcgaaaatctgaatcccctgctgcagatccaccaggaagacttccggtgctgggttgtcgatcaccagtgagcagcgacgcgctgcggtgagcaggatttccgtcacttcttcactgttggcatcggcaggggccggaattgtcaacaccacacgcgtgaccgagtcagagagcgaccagttgataaactgctcggtaataaacgccttgttcggcacgataatttctttgcggtcccagtcgctgatggtggtggcgcgggtgttaattttcgtcacactaccggtaagatcgcggatcgttaccgtatcgccaatgcgaatcggtttttcgaacaggatgatcaggccagagataaagttggcgaaaatttcctgcaaaccaaaaccgagaccaacaccgagcgcggcaaccagccactgcaatttcgaccactcaataccaatcattgagaagccgaccagcccgccaatcagcatcagcagatatttggtgatggtggtgatggcgtagcccgtacccggcgttaaatccaggtgctgcagaatcgccagttccagcagcgcgggcaggttgcgcaccagctgcgtggtgatgataaacaccagaatggcaatcagtaccgcaccgagggtaatcggctccaggctttctacgccctgtaccgtggaagtgacatcccacagcgaaatattttcgaggaagccgaaagcggaatggatttctgaccacagcacaatgaccgaaagcagggcgatcaacatcaaaattgagcgcaccagccgcaaggattgcgcactgatggcatcgagatcgacttcgctttcatcgacttcaattgctccttccgggctactgtgatgatgcgcttcctcttcgccacgcgcacgctgcgctaacatctctgcccggcgatgcttcgcccggtcaaacgccagcctgcggcgctggatcagcatccagcggcggataacgtgataaaccaccagtagcaggaaccagatggcaaccgaggtttcaagcctcgctaacagtgcctgcgccgttgccagataacccaccgccgacgccagaatggcaaccagaggtgcgccaatcatcatgttccacagcatatggttggtaatgttgtcgccgctgccctctttgttgagatacagcgggatcccggcctttttcaggctgagggtgaccaccgccagcgcaccgcaaatgaggataaagcaaagccgtcccagcgaaccggaaaattcgcggtcgtcgaggttatcgaacatcatcagcgccataatcagcggcacaataagcccgatgctcatcaggtagtaacgcatcccacgggaaacacgttcgcgcggccagccaaaatgagcgataaacaagccgttcgggcgagcaaaggtggcgcaaatcatcactacccacagcagcggcacggtggctgttacgccatcaccaatcgcgaccgccagcggataaggccacgcctcgcgcaagccgtaacccagcgtcatccacagcacaggcagcggtgacgcgacgagaatcgaccagaaaagagtgcgtaacgtcagccagaagtgatcctgagtcactttgccgactttcgccgccgaacgttcaagaaaacgggtgaaatagcggcgcgagtaaatactgcaaccgaccagaatcaacgcgccaaacagcggcaaaatcgtctccttactggtcagcatcatcacactggctttgcccaactgactgaaggtgtccagcgaaatgagacgacgcagatcctgggcgatttccagcggccaggcgatggtcatcgggcgcacgtcagaggtccagaacagatagcggtgcgtcgcttcgttcacctctttcagcgcatcctccagttgcccgttggagactttcagcttggtcagctccagcagtagcgtgtcgccaccctgcaacaatgagtttagcaactcacgctgagtgcgtagctgtgcttccagaatacggttttgctcggcggtcagcggctgaccgtcggcctgatggatttgccgtagcagcggctgtttattaagcagatcctcataacgtaaccgttgcacacgtaactgcgccatttcggtatcaagctgttgtggttttggcatttccggtagccgtgccacctgcgcccgcaacgcttcgccgagcaggttagatgatcccagccattgcgactgttcacgcagcgtattcaacgcctgccggacctgtaacgtctggctggcagcctgacgctgttgcgaggcaacgagatccatccgctgcgcctgttgattcagtgccgccgatagttcgcggttaattttaaactgggcgacgatatcttttggcaaatcggcgctactttccgccagttgctcggtactttccagagcccgttccgcttcctgttggcgttgactattcaactggttgcgtagtgcttgcaaatatgcatccagctgctggctctctttttccgccagctcagagcgcaagcgcgctaattcctggcggttattggcagatagctgcgccagctccagttcatcaacgagcgctttcagacgtgcggagtcagactgcaacgcgaaattttgtgcctgattgagcggggtattgccggtaagcgtccccaggcggcgctcgatttcattcaactgacggcgggcatcggtttgctgttgcggcagttgattcagcgaatcggcaatctcgcgggcgcgctcctgctcttgctgggcctgacggcttttatccagcaactgactgctgatctggagaatttcctgattcagcgcatcgttagacattcccggcgacacgctgcgtggctcgtcacgcatgttgtttaactgcgcgcgcagagtggcggaaagtttcggataattatcaatgacttcttgatattgcttgatgcgctcaagggaaccttttcgttcctcaagcgcatttaaggcagactggagcgcctctacgacttccggctgcgcaggtttcgccgcttttgcctgctccagttcctgggtgatttgtttgctatcgggggccgtcgcggcgtacgccccccaactgaggcaccaggccatcagaaaagtgataatcaggcgcacgtcagcgtttcctttgatggattagacctggtcttttttgtcgtcaaccaatgggctggcgtcgtgttctgcttcgatctcttcagcaggaagcggggctggttcagcgtctggcgtaacaaaggtttcggtagatactgccagcggctggccaattttcgtgacagacaggctttccagttgctcaaccaggttcactttacctggtgcaaacaggttgataacggtagagccaagtttaaagcgacccatttcctggcctttcagcaatgccacagaatcgtcgttttccccggcaggccaggtccagcgcttgatgatgccttcgcgcggcggcgtaatggtgcccgcccagaccgtctcaatgctgcctacaatcgtcgcaccgaccagaatctgcgccatcgggccaaattcggtatcgaacaggcagatcacgcgttcgttacgggcaaacagattcggcacgttctgagcagtgagatggttaacggagaagagatcgcccggcacgtagatcatttcacgcagaataccgttgcacggcatgtgtacgcggtggtagtcacgtggggagaggtaagtggtcacaaacgtaccgttacggaagagatccgccatcagatagttgcctgccagcagggcttcgaggctgtagttgtggcctttggcttgcaggattttatcttcttcgattttacccaactggctgataacgccatcggcaggcataaccagtacattcggatcggtatcgattgggcgtacttcgtcacgcagcggacggacaaagaattcgttaaaggtgcggtagctggcggtgtccggcttttgcgcctctttcatgtcgaccttgtagtatttaacgaacagatcgataaccagttttgtcagccatcctgcccgcttgcttgcgccccaacccgccaggcgagtaagccatagtttcggcagaatgtactgtagcgaaagtttaaatgaatttaacaaggtagcctccaggccattgttttgtcgttcctgatccggcctacatgccggatcctgaaaaaaaggggacgattctaacgacggttagcttaattgtcagtcatccgtatcagaaaagtttttacgcgtttttacctgcgccatgctttccagaatacggtgatagttttcgaaacgggtttccgcgatttttccttcctcaaccgcttcccggatagcgcagcccggatcggtatcgtgtttgcaatcgcgatatttacacagacctaaatagtcatggaattcgacaaagccctgagtgatttgttccggctccaggtgccagagaccaaactcacgcacacctggggaatcaatcacatcaccgccgtgcgggaagtgatacagtcgtgcggcggtcgtggtgtgctgaccaagccccgagttgtcagagacatcgttggtcaggatctctttttgcagccccagcaacgcgttcagcaggctggatttgccaacgccagactgcccggcaaaaatgctgatgcgcccggtcaacgcctcttccagcggtttcagcccatcctgagtatgactggaaaccatcaatacgcgataaccgatattgcggtagatatccatctgctcgttgacgaactccatgccttcgtcgtccagcaggtctatcttgttgagcacaataatcggctcaatctgcaaggtttcgcaggccaccaggtaacggtcgataatattgagcgacagctccggcaaaatggcggagacaatgacaatctggtcgatgttggcagcaataggtttcacaccgtcgtaaaaatccgggcgcgtcaacactgaggtgcgctcatgcaccgcttccacgatccctttgacatttacgccttccgccgctggtttacccggacgccagactacgcggtcgccggtcaccaacgaacggatggtacggcgaatattgcagcggtgaacgtcgccatcggcggattccacatcagcgtgcataccaaagcggctgatgacgataccttcatcaggctcgccaaacagattgtcgtcgtagtcgggcttctccttagacgttttaagacgacgctggtgattggcgttcacgcggcgctgctggcctttggagagtttatttttactcaatcgtacagactcctggtcgcccctgatgggcaaaacatctatgatacacgcaattgtggatcaatatagtcactgtgaatgggtggaaaatagcatgagtgccaatgaaaacaacctgatttggatcgatcttgagatgaccggtctggatcccgagcgcgatcgcattattgagattgccacgctggtgaccgatgccaacctgaatattctggcagaagggccgaccattgcagtacatcagtccgatgaacagctggcgctgatggatgactggaacgtgcgcacccataccgccagcgggctggtagagcgtgtgaaagcgagcacgatgggcgatcgtgaagctgaactggcaacgctcgaattcttaaaacagtgggtgcctgcgggaaaatcgccgatttgtggtaacagcatcggtcaggaccgtcgcttcctgtttaaatacatgccggagctggaagcctacttccactaccgctatctcgatgttagcaccctgaaagagctggcgcgccgctggaagccggaaattcttgacggctttaccaagcaggggacgcatcaggcgatggatgatatccgtgaatcggtggcggagttggcttactaccgcgagcattttatcaagctgtaaaatttttcctggtcacgtaagcgccggaatccacttgcggcggcgtgattttgacgctaaattgaacgtcttgctgataatttcagcacttgagataaaaactcaaaaaaaattttttaggggggttgcagagggaaagatttctcgtataatgcgcctcccgtaacgacgcagaaatgcgaaaattacgaaagcaaaattaagtagtacgcgggaatagctcagttggtagagcacgaccttgccaaggtcggggtcgcgagttcgagtctcgtttcccgctccaaaatttgaaaagtgctgtaaagcacagaccacccaagcgggaatagctcagttggtagagcacgaccttgccaaggtcggggtcgcgagttcgagtctcgtttcccgctccaaaatttgaaagtgctgtaaagcacagaccacccaagcgggaatagctcagttggtagagcacgaccttgccaaggtcggggtcgcgagttcgagtctcgtttcccgctccaaattcttctctcaataaaatatccacagcgacgcgatgcgttattgctggtttttgttgtctctgacaaactcttgtaaacagagttatccacagtctcaggctgtaatcttaatttcaaagaaacttcgcacggtgaatagtatttttttaacctattgatagataagttaaaaattaagattccgttttgtcgagtcgatcacttgacgattttattcatcttgaattgcaatgcgtttttatttttattcacaggctgtggatgaatcaggcgtcacgcggtaaccctttttcaatcacccgaaccagacgctgttttttcggtaattgcacttcgactatgcacgcatttcgcctctcgatttgctgcgcaatcgcccacgctatgtgctcatcgagaagtgggtgctcacctttacgactttccagcgctgtcaaaatcgtttcatcccagggggcattgcctaatgctacggcgatattacgcagccaacgcaggtgacctatacggcgaatcgccgaaccttccgtgacttttaaaaactgctcttcgctccaggcgaataactcaatgagttccggagcgtgtagcggcttacgcgggctgaaatcgtcttctgtagtgagttgcgaatagcgattccacgggcagataagctggcagtcatcgcaaccataaatacgatttcccattaacggtcgcaactcttccgggatcgccccctccagttcgatggtgagataagagatacagcggcgagcatcgacggtatatggctcgacgatggcaccggtcgggcaaatcgtcatacaggccacgcatttaccgcatccttcctcgactggttgatccacgggcagcggaatatcgaccagcaattcgcctaaaaagaagaacgaaccggcctcgcgattgaggataagtgagtgcttacctgtccagccaagacctgctttttcagctaacgggcgctcgagaataggcgcagaatcgacaaacggtctaaaattcagcgaaacacaatgttgctgaatcatctcgcccagctttttgagtcggttgcgcagaagcttgtgatagtcacggcccagcgcataacggctaacatagccgagtttgggatttttcagcgtgctggcaaatgcggcgttagcaggaaggtaattcatccgaacgctgatcacgcgcagcgtaccgggcaataattcgtgaggacgagcacgcagcataccgtgacgcgccatccagtccatttcgccgtggtattgtttgtccagccatgcttgcagtttgggctcggacgcgctgagatcggtatcggtaatacctacctgctgaaagcccagttccagcccccactgtttaatattttgcgctaattgattgagatcgaggggctctgacatgacggaccatacaatgaagaaaaaccccgtaagtataccacacaccgtctggtacgccgacgatatccgccgcggagaacgcgaggcggcagatgcgctggggctcacactctatgagctgatgcttcgcgctggcgaagccgcattccaggtgtgtcgttcggcttatcctgacgcccgccactggctggtgctgtgcggtcatggtaataacggcggcgatggctacgtggtcgcgcggctggccaaagcgatcggtattgatgtcacgctgctggcccaggaaagtgacaaaccgttgccggaagaggccgcgctggcacgcgaagcatggttaaacgcgggaggcgagatccatgcttcgaatattgtctggcccgaatcggtagatctgattgttgatgcgctgctcggcaccggcttgcagcaagcgccccgcgaatccattagccagttaatcgaccacgctaatactcaccctgcgccgattgtggcggttgatatcccttccggccttctggctgaaaccggcgctacgccaggcgcggtaatcaacgccgatcacaccatcacttttattgcgctgaaaccaggcttgctcactggaaaagcgcgggatgttaccggacaactgcattttgactcactggggctggatagctggctggcaggtcaggagacgaaaattcagcggttttcggcagaacaactttctcagtggctgataccgcgtcgcccgacttcgcataaaggcgatcacgggcggctggtgattattggtggcgatcacggcacggcgggggctattcgtatgacgggggaagcggcgctgcgtgctggtgctggtttagtccgagtactgacccgcagtgagaacattgcgccgctgctgactgcacgaccggaattgatggtgcatgaactgactatggactctcttaccgaaagcctggaatgggccgatgtggtggtgattggtcccggtctgggccagcaagagtgggggaaaaaagccctgcaaaaagttgagaattttcgcaaaccgatgttgtgggatgccgatgcattgaacctgctggcaatcaatcccgataagcgtcacaatcgcgtgatcacgccgcatcctggcgaggccgcacggttgttaggctgttccgtcgctgaaattgaaagtgaccgcttacattgcacccaacgtctggtacaacgttatggcggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaaatgagcccttatgatgcagcctgtgcgggctgtgtcgcgcacggtgcggcagctgacgtactggcggcgcgttttggaacgcgcgggatgctggcaaccgatctcttttccacgctacagcgtattgttaacccggaagtgactgataaaaaccatgatgaatcgagtaattccgctccctgatgagcaggcaacattagacctgggcgagcgggtagcgaaagcctgcgatggcgcaaccgtaatctatctgtatggcgatttaggtgcaggtaaaaccacctttagccggggctttttacaggctctgggtcatcagggtaatgtcaaaagccccacttatacgctggtcgaaccctatatgctcgacaatttaatggtttatcactttgatttgtaccgccttgccgatcccgaggagctggagtttatggggatccgcgattattttgccaacgatgccatctgcctggtggagtggccacaacaaggtacaggtgttcttcctgacccggatgtcgaaatacacattgattatcaggcacaaggccgtgaggcgcgcgtgagtgcggtttcctctgcgggtgaattgttgctggcgcgtttagccggttaacctttgaaaggtggcgggatgatgtatcgcatcagaaattggttggtagcgacgttgctgctgctgtgcgcgcaggtgggtgccgcgacgctctctgatattcaggtttctaacggcaaccaacaggcgcggataacgttgagttttattggcgatcctgattatgcgtttagccatcaaagcaaacgcaccgtggcgctcgatatcaaacaaacgggcgtgattcagggactgccgttgttgttcagcggcaataatctggtgaaggcgattcgctctggaacgcctaaagatgcacaaacgctacggctggtggtcgatcttaccgaaaatggtaaaaccgaagcggtgaagcggcagaatggcagcaattacactgtcgtctttacgattaacgccgatgtgccgccaccgcctcctccgccgcctgtggttgcgaaacgcgttgaaacgcctgcggttgtcgcaccgcgcgtcagcgaaccggcgcgcaatccgtttaaaacggaaagtaaccgcactacgggtgttatcagcagtaatacggtaacgcgtccggcagcgcgcgcgacggctaacacaggcgataaaattatcatcgctattgatgccggacacggcggtcaggatcctggcgctatcggccccggtggtacgcgggagaaaaatgtcaccatcgccatcgcgcgtaaattgcgtactttgctcaataacgatccgatgtttaaaggcgttttaacccgtgacggggattactttatctcggtgatggggcgcagtgatgtggcacgtaagcaaaacgccaatttccttgtatcgattcatgccgatgccgcaccaaaccgtagtgccaccggtgcctctgtatgggtgctctcaaaccgtcgcgccaacagcgaaatggcaagctggctggaacagcatgagaagcagtcggagctgctgggcggggcgggtgatgtgctggcgaacagtcagtctgacccctatttaagccaggcggtgctggatttacagttcggtcattcccagcgggtagggtatgatgtagcgaccagtatgatcagtcagttgcaacgcattggcgaaatacataaacgccgaccagaacacgcgagtctcggcgttctgcgttcgccggatattccgtcagtactggtcgaaaccggttttatcagtaacaacagcgaagaacgtttgctggcgagcgacgattaccaacaacagctggcagaagccatttacaaaggcctgcgcaattacttccttgcgcatccgatgcaatctgcgccgcagggtgcaacggcacaaacggccagtacggtgacgacgccagatcgcacgctgccaaactaaggacgattgatgccaattcaggtcttaccgccacaactggcgaaccagattgccgcaggtgaggtggtcgagcgacctgcgtcggtagtcaaagaactggtggaaaacagcctcgatgcaggtgcgacgcgtatcgatattgatatcgaacgcggtggggcgaaacttattcgcattcgtgataacggctgcggtatcaaaaaagacgagctggcgctggcgctggcgcgtcatgccaccagtaaaatcgcctctctggacgatctcgaagccattatcagtctgggctttcgcggtgaggcgctggcgagtatcagttcggtttcccgcctgacgctcacttcacgcaccgcagaacagcaggaagcctggcaggcctatgccgaagggcgcgatatggacgtgacggttaaaccggcggcgcatccggtgggaacgacgctggaggtgctggacctgttctacaacaccccggcgcggcgcaaattcctgcgcaccgagaaaaccgaatttaaccatatcgatgaaatcatccgccgcattgcgctggcgcgtttcgacgtcactatcagtctgtcgcataacggcaaaatcgtacgccagtatcgtgcagtgccggaaggcgggcaaaaagaacggcgtttaggcgcgatttgcggcaccgcttttctcgaacaagcgctggcgattgaatggcaacacggcgatctcacgctgcgcggctgggtggccgatccaaatcacactacgcccgcactggcagaaattcagtattgctacgtgaacggtcgcatgatgcgcgatcgcctgatcaatcacgcgatccgccaggcctgcgaagacaaactgggggccgatcagcaaccggcatttgtgttgtatctggagatcgacccgcatcaggtggacgtcaacgtgcaccctgccaaacacgaagtgcgtttccatcagtcgcgtctggtgcatgactttatctatcagggcgtgctgagcgtgctacaacagcaactggaaacgccgctaccgctggacgatgaaccacaacctgcaccgcgtgccattccggaaaatcgcgtggcggctgggcgcaatcactttgctgaaccggcagttcgtgagccggtagctccgcgctactctcctgcgcccgcctcaggcagtcgtccggctgcctcctggccgaatgcgcagcctggttaccagaaacagcaaggtgaagtgtatcgccagcttttgcaaacgcccgctccgatgcaaaaaccaaaagcgccagaaccgcaggaacctgcacttgcggcgaacagtcagagttttggtcgggtactgactatcgtccattccgactgtgcgttgcttgagcgcgatggcaacatttcacttttatccttgccagtggcagaacgttggctgcgtcaggcacaattgacgccgggtgaagtgccagtttgcgcccaaccgctgcttattccgttgcggctaaaagtttctggcgaagaaaaatcggcattagaaaaagcgcagtctgccttggcggaactgggtattgatttccagtccgatgcgcagcatgtgaccatcagggccgtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgatatcagtaaggcgagcctgcctaaggcgatttttttgatggggccgacggcctccggtaaaacagcgttagccattgagctgcgtaaaattttaccagtagagttgataagcgttgattctgcccttatttacaaagggatggatatcgggacggcgaagccgaacgctgaagagttactcgccgcgccgcaccgattgctgaatattcgcgatccgtcgcaggcttactcggctgctgattttcgccgcgatgcgctggcggaaatggccgatatcaccgcggcggggcggatcccactattagtgggcggtacgatgttgtatttcaaggcattgctggaagggttgtcgccgctaccgtcggcagacccggaagtacgggccagaattgagcaacaggcggcagagcaaggttgggagtcattgcatcgtcaacttcaggaggtagatccggttgcggcagcaaggattcatccaaatgatccacaaaggctttcccgggcactggaagtttttttcatttcgggtaaaactttaacggaactgacgcaaacgtcaggagacgctctaccgtatcaggtgcatcagttcgccatcgccccggcgagccgtgaactgctccatcaacgaattgagcagcgttttcatcagatgttggcttcaggttttgaagcagaagtccgggcgctttttgcccgaggagatttgcatacggatttgccttccattcgttgcgtgggttatcgccagatgtggtcttaccttgaaggcgaaatctcatacgatgaaatggtttatcgaggtgtttgcgccacgagacagttggcgaagcggcagataacctggctgcgtggttgggaaggggttcactggcttgacagtgaaaaaccagaacaggcgcgtgacgaagtattacaggttgttggtgctatcgcaggctgaatgtgtacaattgagacgtatcgtgcgcaattttttcagaatcgaaaggttcaaagtacaaataagcatataaggaaaagagagaatggctaaggggcaatctttacaagatccgttcctgaacgcactgcgtcgggaacgtgttccagtttctatttatttggtgaatggtattaagctgcaaggacaaatcgagtcttttgatcagttcgtgatcctgttgaaaaacacggtcagccagatggtttacaagcacgcgatttctactgttgtcccgtctcgcccggtttctcatcacagtaacaacgccggtggcggtaccagcagtaactatcatcatggtagcagcgcgcagaatacttccgcgcaacaggacagcgaagaaaccgaataaggtttcgggctatttttttacacggggagccagcgatcctgcgttccccgctgatctatttagagggttatacgcttgtttgaccgttatgatgctggtgagcaggcggtactggtacacatctattttacgcaagacaaagatatggaagacctccaggagtttgaatctctggtctcttccgccggtgtcgaagcattgcaggtgattaccggtagccgtaaagcgccgcacccaaagtattttgtaggtgaaggtaaagcagttgaaattgcggaagccgtaaaagcgacaggagcttcggtcgttctttttgaccatgccctgagcccggcgcaggagcgtaacctggagcgtttgtgcgagtgtcgtgtcatcgaccgcaccggccttattttagatattttcgcccaacgtgcgcgtacccatgagggtaagttgcaggttgagttggcgcagttgcgccatctggctacgcgcctggtgcgtggctggacccaccttgaaagacagaaaggcgggattggtttgcgtggtccgggtgaaacccagctcgaaaccgaccgtcgtttgttgcgtaatcgcatcgtgcagatacagtcgcgcctggaaagagttgaaaagcagcgtgagcaggggcggcaatcgcgtatcaaagccgacgttcctactgtttcgctggtgggatataccaacgccggtaaatctactcttttcaatcgcatcaccgaagcgcgggtctacgcggcagaccagttgtttgccaccctcgacccgacgttgcggcgtattgacgttgcggatgtcggtgaaaccgtgttggcagataccgtagggtttattcgccacctgccgcacgatctggtggcggcatttaaagccacgttacaagagacgcggcaagccacattgctgctgcacgtcattgacgcggcggatgtgcgtgtacaagaaaacatcgaagcggtgaatacggttcttgaagagattgatgctcacgagatcccaaccctgctggtgatgaacaagatcgatatgctggacgatttcgaaccgcgtattgacagagatgaagagaacaaaccgatccgtgtctggctttctgcgcagaccggagcggggataccacagctttttcaggctttgacggagcgtctttccggcgaggtggcgcagcatacattgcgtctgccgccgcaggaagggcgcctgagaagtcgtttttatcagcttcaggcaatagaaaaagagtggatggaggaggacggcagcgtaagtctgcaagttcgtatgccgatcgttgactggcgtcgcctctgcaaacaagaaccggcgttgatcgattacctgatctaacggcgtagcgtctgaagcgtggagtcatatcctctggcgtcgaaagacaacagggatcaccgcataacaaatatggagcacaaacatggcgtggaatcagcccggtaataacggacaagaccgcgacccgtggggaagcagcaaacctggcggcaactctgagggaaatggaaacaaaggcggtcgcgatcaagggccacctgatttagatgatatcttccgcaaactgagcaaaaagctcggtggtctgggcggcggtaaaggcaccggatctggcggtggcagttcatcgcaaggcccgcgcccgcagcttggcggtcgcgtcgttaccatcgcagcggcagcgattgtcattatctgggcggccagtggtttctataccattaaagaagccgaacgcggcgtggtaacacgctttggtaaattcagccatctggttgagccgggtctgaactggaaaccgacgtttatcgacgaagtcaaaccggtgaacgtggaagccgtgcgtgaactggcagcttctggtgtgatgctgacgtcggacgagaacgtagtgcgcgttgagatgaacgtgcagtaccgcgtcaccgatccggaaaaatatctgtatagcgtgaccagcccggatgacagtctgcgtcaggctaccgacagcgccctgcgcggggttatcggtaaatacaccatggaccgcattctgacggaaggtcgtaccgtgattcgtagcgatactcagcgcgaactggaagagacgattcgtccgtatgacatgggcatcactctgctggacgtcaacttccaggctgctcgtccgccggaagaagtaaaagcggcgtttgacgatgcgattgccgcgcgtgaaaacgaacagcaatacattcgtgaagcagaagcgtataccaacgaagttcagccgcgtgcgaacggtcaggcgcaacgtatcctcgaagaggcgcgtgcgtacaaggcccagaccatcctggaagctcagggtgaagtggcgcgctttgctaaacttctgccggaatataaagccgcgccggaaattactcgcgagcgtctgtatatcgagacgatggaaaaagtgttgggcaacacccgcaaagtgctggttaacgataaaggtggaaacctgatggttctgccgttagaccagatgctgaaaagtggtaacgcccctgcggcgaagagcgataacggtgccagcaatctgctgcgtctgccgccagcctcttcctccacaaccagtggagcaagcaacacgtcgtccaccagtcagggcgatattatggaccaacgccgcgccaacgcgcagcgtaacgactaccagcgtcagggggaataacgatgcgtaagtcagttatcgcgattatcatcatcgtgctggtagtgctttacatgtctgtctttgtcgtcaaagaaggtgagcgcggtattacgctgcgttttggtaaggtactgcgtgacgatgacaacaaacctctggtttatgagccgggtctgcatttcaagataccgttcattgaaacggtgaaaatgctcgacgcacgtattcagaccatggacaaccaggccgaccgctttgtgaccaaagagaagaaagacctgatcgtcgactcttacatcaaatggcgcatcagcgatttcagccgttactatctggcaacgggtggtggcgacatttcgcaagcggaagtgctgttgaaacgtaagttctctgaccgtctgcgttctgaaattggtcgcctggacgtgaaagacatcgtcaccgattctcgtggtcgtctgaccctcgaagtacgtgacgcgctgaactccggttctgcgggtacagaagatgaagttactacccctgcagcagataacgccattgccgaagcggcagagcgcgtaacggctgagacgaagggcaaagttccggtcatcaatccgaacagtatggcggcgctgggtattgaagttgtcgatgtgcgaattaagcagatcaacctgccgaccgaagtgtctgaagcgatctacaaccgtatgcgcgccgagcgtgaagcggtagcgcgtcgtcaccgttcacaaggtcaggaagaagcggaaaaactgcgtgcaactgccgactatgaagtgaccagaacgctggcagaagctgagcgtcagggccgcatcatgcgtggtgaaggcgatgcagaagcagccaaactgtttgctgatgcattcagtaaagatccggacttctacgcattcatccgtagcctgcgtgcttatgagaacagcttctctggcaatcaggacgtgatggtcatgagcccggacagcgatttcttccgctacatgaagacgccgacttccgcaacgcgttaatataacgactgcggtacaggtcaataaagccaccacatcctcagggatgtcggtggttttctttttctataaggataatgaatgaattcgacaatctggctggcgcttgccctggttttggtactggaaggtttagggccgatgctttacccgaaggcatggaagaagatgatctctgcaatgaccaatttgcccgataatattttacgtcgttttggcggtggacttgtggttgcgggcgttgtggtctactacatgttgaggaaaacgattggctgaacaaaaaacagactgatcgaggtcatttttgagtgcaaaaagtgctgtaactctgaaaaagcgatggtagaatccatttttaagcaaacggtgattttgaaaaatgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggctgcgctgatgaaagagatgaaagaactggaagaccgtggcatccccgttcgtgagcgtctgctgctgtccgaagcatgtccgctgatccttgattatcacgttgcgctggataacgcgcgtgagaaagcgcgtggcgcgaaagcgatcggcaccaccggtcgtggtatcgggcctgcttatgaagataaagtggcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggttgttgacgtttctgatctgctcgaccaggcgcgtcagcgtggcgatttcgtcatgtttgaaggtgcgcagggtacgctgctggatatcgaccacggcacttatccgtacgtaacttcttccaacaccactgctggtggcgtggcgaccggttccggcctgggcccgcgttatgttgattacgttctgggtatcctcaaagcttactccactcgtgtgggtgcaggtccgttcccgaccgaactgtttgatgaaactggcgagttcctctgcaagcagggtaacgaattcggcgcaactacgggtcgtcgtcgtcgtaccggctggctggacaccgttgccgttcgtcgtgcggtacagctgaactctctgtctggcttctgcctgactaaactggacgttctggatggcctgaaagaggttaaactctgcgtggcttaccgtatgccggatggtcgtgaagtgactaccactccgctggcagctgacgactggaaaggtgtagagccgatttacgaaaccatgccgggctggtctgaatccaccttcggcgtgaaagatcgtagcggcctgccgcaggcggcactgaactacatcaagcgcattgaagagctgaccggtgtgccgatcgatatcatctctaccggtccggatcgtactgaaaccatgattctgcgcgacccgttcgacgcgtaattctggtacgcctggcagatattttgcctgccgggctaacagtgtgatacattgctgtgtcggttaagccattacgctatccgacacagtgttaaatcctcgcttttttccttccccgaactgaaataaattagcgacacagcttgtggctggtttatcatcaatataaatgtatttttccccgatttcccttttgaggttgatgtgcagttaacgagtttcactgattacggattacgtgcgctgatctacatggcgtcattgccagaagggcggatgaccagtatttctgaagtgactgacgtctacggcgtctcccgtaatcatatggtcaaaataatcaatcaacttagtcgtgccggctacgtgactgctgttcgtggaaaaaatggcggcattcgcttgggtaaaccggcgagtgcaatacgtattggtgatgtggtgcgcgagctggagcccttatcgctggtgaattgcagcagtgagttttgccacattacacctgcctgtcggttgaaacaggcgctttctaaggccgtgcaaagttttcttacggaactggataactacacgcttgccgatttggttgaagagaatcaaccgctttataaattattgctggtggagtgacgaaaatcttcatcagagatgacaacggaggaaccgagatgtcacaagatcctttccaggaacgcgaagctgaaaaatacgcgaatcccatccctagtcgggaatttatcctcgaacatttaaccaaacgtgaaaaaccggccagccgtgatgagctggcggtagaactgcacattgaaggcgaagagcagcttgaaggcctgcgtcgccgcctgcgcgcgatggagcgcgatggtcaactggtcttcactcgccgtcagtgctatgcgctgccggaacgcctcgacctggtgaaaggtaccgttattggccaccgtgatggctacggctttctgcgagttgaagggcgtaaagatgatttgtatctctccagcgagcagatgaaaacctgcattcatggcgatcaggtgctggctcagccgctgggcgctgaccgtaaaggtcgtcgtgaagcgcgtattgtccgcgtactggtgccaaaaaccagccagattgttggtcgctacttcaccgaagcgggcgtcggctttgtggttcctgacgatagccgtctgagcttcgatatcttaatcccgcccgatcagatcatgggcgcgcggatgggctttgtggtggtggttgaactgactcaacgcccgactcgccgtaccaaagcggtgggtaaaatcgtcgaagtgctgggcgacaatatgggcaccggcatggcggttgatatcgctctgcgtacccatgaaattccgtacatctggccgcaggctgttgagcaacaggttgccgggctgaaagaagaagtgccggaagaagcaaaagtgggccgtgtcgatctgcgcgatttaccgctggtcaccattgatggcgaagacgcccgtgactttgacgatgcagtttactgtgagaaaaaacgcggcggcggctggcgtttatgggtcgcgattgccgacgtcagctactatgtgcgtccgccaacgccgctggacagagaagcgcgtaatcgtggtacgtcggtgtacttcccttcgcaggttatcccgatgctgccggaagtgctctctaacggcctgtgctcgctcaacccgcaggtagaccgcctgtgtatggtgtgcgagatgacggtttcgtcgaaaggccgcctgactggctacaaattctacgaagcggtgatgagttctcacgcgcgtctgacctacaccaaagtctggcatatactgcaaggcgatcaggatctgcgcgagcagtatgcgccgctggttaagcatctcgaagagttacataacctctataaagtgctggataaagcccgtgaagaacgcggtgggatctcatttgagagcgaagaagcgaagttcattttcaacgctgaacgccgtattgaacgtatcgaacagactcagcgtaacgacgcccacaagttaattgaagagtgcatgattctggcgaatatctcggcggcgcgtttcgttgagaaagccaaagaaccggcactgttccgtattcacgacaagccgagcaccgaagcgattacctctttccgttcagtgctggcggagctggggctggaactgccgggcggtaacaagccggaaccgcgcgactatgcagagttactggaatcggttgccgatcgtcctgatgcagaaatgctgcaaaccatgcttttgcgctcgatgaaacaggcgatttacgatccggaaaaccgtggtcacttcggtctggcattgcagtcctatgcgcactttacttcgccgattcgtcgttatcctgacctgacgttgcaccgcgccattaaatatctgctggcgaaagagcaggggcatcagggcaacaccactgaaaccggcggctaccattattcgatggaagagatgctgcaactgggtcagcactgttcgatggcggaacgtcgtgccgatgaagcaacgcgcgatgtgtctgactggctgaagtgtgacttcatgctcgaccaggtaggtaacgtctttaaaggcgtaatttccagcgtcactggctttggcttcttcgtccgtctggacgacttgttcattgatggtctggtccatgtctcttcgctggacaatgactactatcgctttgatcaggtagggcaacgcctgatgggtgaatccagcggccagacttatcgcctgggcgatcgcgtggaagttcgcgttgaagcggttaatatggacgagcgcaaaatcgactttagcctgatctccagcgaacgcgcaccgcgcaacgtcggtaaaacggcgcgcgagaaagcgaaaaaaggcgatgcaggcaaaaaaggcggcaagcggcgtcaggtcggcaaaaaggtcaactttgagccagacagcgcctttcgcggcgagaaaaaaccgaagccgaaagcagcgaagaaagacgcgagaaaagcgaaaaagccatcggtgaaaacgcagaaaatagccgcagcgaccaaagcgaagcgtgcggcgaagaaaaaagtggcagagtgataattcaccctcttcaaacagaagagggtgaattatccgtaggccgggcaagcgtggcgctcccggcaaaacgtaaacaacgagtacattaatgagcgaaatgatttacggcatccatgcagtgcaggccctgctggagcgcgcccctgaacgttttcaggaagtctttattttaaaaggccgtgaagataaacgtctgttaccgctgattcacgcccttgagtctcagggcgtggttatccagttggcaaaccgccaatatctcgatgagaaaagcgacggtgccgtgcatcagggcattatcgctcgtgtgaagccaggacggcagtatcaggaaaacgatctgccggatctgatcgcttcgctcgatcaaccgttcctgctgatcctcgacggcgtaaccgatccgcacaacctcggcgcgtgtctgcgtagcgcggacgccgctggtgttcatgcggtgattgtgccgaaagatcgctccgcacagctcaacgccacggcgaaaaaagtggcctgtggtgcggcagaaagcgttccgctgattcgggtgactaatctggcgcgcaccatgcgtatgttgcaggaagagaatatctggatcgtcggtacggcaggcgaggcggatcatacactctatcagagcaaaatgaccggacgcctggcgctggtgatgggcgcggaaggtgaaggtatgcgtcgcctgacccgtgaacattgcgatgagttgatcagcatcccaatggcaggaagtgtttcttccctgaacgtttcggttgcaaccggaatttgcttatttgaagcggttcgtcagcgcagctagttcctctgaattatgaaaagccatccagatttggatggtttttttttgtctatagctggtaagataattacgtactgcaaatattaattttattaatatttaaacttaatctatatggaataatatatgacatggaatccgttggcgctggcgacggcgctgcaaactgtacctgaacaaaatattgatgtaacaaatagcgaaagcgcattaattattaaaatgaatgattatggcgatttgcaaatcaatattctttttacttcccgccaaatgatcatcgaaacctttatttgtccggtaagtagtatcagcaatccagatgaatttaataccttcttattaagaaatcagaagctgatgccattgtcatcggtagggatctccagcgtgcaacaggaagagtattacattgttttcggtgcgttatcgcttaaatcttctcttgaagatatcctgcttgagataacctcgctggtagataacgcattggatctggctgaaattacagaagaatattcacactaattacaaggacgggtatttatgggaattttaaaaagtttatttacgctggggaaatcgtttatctcccaggcggaagagtccattgaagaaacccagggcgtgcgcatgctggaacagcatattcgtgacgctaaagctgaactcgataaagccggaaaatctcgcgttgatctgctggcgcgagtgaaattaagtcacgataagctgaaagatttacgtgagcgcaaagccagtctggaagctcgtgcgctggaagcgttaagcaagaacgtgaatccgtcgttgattaacgaagttgctgaagaaatcgcgcgccttgagaatctcattaccgctgaagagcaagtgttgtcgaatctggaagtctctcgtgatggcgtggaaaaagcagttacagcgacagcgcagcgtatcgctcagtttgagcagcaaatggaagtcgttaaagccactgaagccatgcagcgtgcacaacaggctgtaacgacctctactgttggcgcatcttccagcgtttcgacagcggcagaatccttaaaacgcctgcaaacgcgtcaggccgaacgtcaggctcgcctggatgctgccgcacagttggaaaaagtcgcagacggtcgcgatctcgatgaaaagctggcggaagccggaattggcggtagcaataaaagtagcgcccaggatgtattagcaagactgcaacgccaacagggcgagtaattttttgccagcctcactgcaaggctggcaactattttaaggataaaatatgtctggttttttccagcgtctgtttggcaaggataataagcctgctatcgctcgcggtccgttgggtctgcatctcaatagtggttttacgctcgatacgttagcgtttcgtttgctggaagatgcattgctgatcgagctaccgggtgaagaatataccgtggccgccgtcagttgcatcgatctgggcgggggtagccagattttccgttactacacttcgggcgatgagttcctgcaaatcaataccactggcggcgaagatattgatgacattgatgatatcaagctctttgtctatgaagagagctacggtatcagtaaagagagtcactggcgcgaggcgatcaacgccaaagcgatgggggcaatgaccttaaactggcaggaaaaacgctggcagcgattttttaacagcgaagaaccgggaaatatcgaacccgtctacatgctggaaaaagtagaaaatcaaaaccatgctaaatgggaagtgcataattttagcatgggctaccaacggcaggtgaccgaagatacttacgaatatttgctgttaaatggtgaggaatcttttaacgatctcggcgagccggagtggttattttcgcgcgcgctgggtgtcgatatcccgataacatcacttcatattattggttaattacaaggacgtttacaatgcatatactggattcacttcttgcctttagtgcctatttttttattggcgtggcgatggtgattattttcctgtttatctactccaaaattacaccgcacaacgaatggcagttaatcaaaaacaataacaccgcggcggcactggcgttcagcggaacattgttggggtacgtgatccccttatccagtgcggcaatcaatgcggtgagtattccagactatttcgcatggggcgggattgctctggtgattcaattactcgtttttgctggcgtcaggctttatatgcctgcattaagcgaaaaaattattaatcacaataccgcagcaggaatgtttatgggaaccgccgcgctggctggcggtatttttaacgcagcttgtatgacatggtaatggacgatcatggccagaaaacgcaaatccagaaataacaaaaatatcggacatggggcaatcagtcgcattggtagaccgcataatccttttgagccgcgccgcaatcgctacgcacaaaaatacttaacgttggcactaatgggcggtgccgcttttttcgtattgaaaggttgtggcgatagtggcgatgtcgataacgacggcgacggaacgttttacgcgactgcgcaggattgtattgatgatggtaataattcagatatctgtgctcatggctggaacaacgccaaagcggcattttatgccgatgttccgaagaatatgactcagcataattgtcagtctaagtacgaaaattgctactacgacaatgttgaacagagttggatcccggtcgtttctggatttttgttaagccgggttattcgtaaagatcgcgatgagccgttcgtctataacagcggcggatcctcatttgcttcccgccccgtctggcgcaacacttccggtgattactcctggcgctccggttctggcaaaaaagagtcttactcttcgggcggctttaccaccaaaaaagcgtcaaccgtttctcgcggcggctatggtcgttcttccagcgcccgtgggcattggggaggctaatcatgctgagacacaacgttcctgtgcggcgggatctggaccggattgccgccgataacggatttgactttcatatcatcgacaatgaaatctattgggatgagagtcgggcttatcgctttactttgcgccagattgaagagcagatcgaaaaaccgaccgcggaactgcatcagatgtgcctggaggtggtggatcgcgcggttaaagatgaagagatcctgacgcaactggcgatcccgccgttgtactgggatgtgatcgccgaaagctggcgcgcacgcgatccttcgttgtatggccgtatggattttgcctggtgtggtaatgcaccggttaagttgctggagtacaacgccgatacgccaacttcattgtacgagtcggcttatttccagtggttgtggctggaagatgcccggcgcagcggcgttattccgcgtgatgccgatcagtacaatgccattcaggaacgcctgatttcacgttttagcgagctttacagtcgggaaccgttttatttttgctgctgtcaggacaccgacgaagacaggagtaccgtgctgtacttgcaggactgcgccgagcaggcagggcaggagtctcggtttatctacattgaagagctcggtttgggcgtcggcggcgtactgaccgatcttgatgataatgtcatccagcgtgcatttaagctgtatccgctggagtggatgatgcgtgacgataacggcccgctgctgcgcaagcgtcgtgagcaatgggtggagccgttatggaaaagtatcttgagtaataaagggctaatgccgctgctttggcgcttcttccctggtcatcctaaccttcttgcatcctggttcgatggtgaaaaaccgcagattgccgctggcgaaagctatgtgcgtaaaccgatttactcgcgcgaaggcggaaacgtcaccattttcgacggtcagaataacgttgttgaccacgctgatggtgattacgccgatgaaccgatgatctaccaggcgtttcaacctctgccgcgatttggcgatagctacacactcatcggtagctggattgtcgatgatgaagcgtgcggaatggggatccgtgaagataacacgttgatcaccaaagacacctcacgtttcgttccgcattacattgctggataagaatgttttagcaatctctttctgtcatgaatccatggcagtgaccatactaatggtgactgccattgatggagggagacacagtgcactggcaaactcacaccgtttttaatcaacctataccattaaataacagcaacttatacctgtctgatggcgcgctttgcgaagcggtaacgcgtgaaggtgctggctgggatagcgattttctcgccagtattggtcagcagttaggaacggctgaatcccttgagctggggcggctggcgaatgtgaatccgcctgaattattgcgctacgatgcgcaaggacgccgtctggacgatgtgcgttttcaccccgcctggcacctgctgatgcaggcgctatgtaccaatcgggtgcacaatcttgcctgggaagaagacgctcgctccggcgcatttgtggcgcgcgcggcgcgttttatgttacatgcgcaggttgaggctgggtcgttatgtccgataacgatgacctttgccgccacgccattgttgttacagatgttacccgcgccgtttcaggactggaccacgccgctgctgagcgatcgctacgattctcacttattgccaggtgggcaaaaacgtggcttgttgatcggcatgggaatgacggaaaagcagggcggttccgatgtcatgagcaacaccacccgcgcagagcgtctggacgatggttcttatcggctggtggggcataaatggtttttctcggtgccgcaaagcgatgcgcatctggtgctggcacagaccgcgggcggtttgtcctgcttttttgtgccgcgctttttgcctgacgggcaacgcaacgcgattcgcctcgagcggctgaaagataagctgggtaatcgctctaacgccagctgcgaagtggagtttcaggatgccattggctggttgttggggcaggaaggggaaggaattcgtctgatcctgaaaatgggtgggatgacgcgttttgattgcgccctgggtagccatgccatgatgcgccgtgcattttcgctggcgatttaccatgcacatcaacgccatgtttttggtaatccattgatccaacagcctcttatgcgtcatgtcttaagtcgcatggcacttcagcttgaagggcaaacggcgttgctgtttcgtcttgcgcgagcgtgggaccggcgcgccgatgccaaagaagctctgtgggcgcgtttatttacgcctgcggcgaaatttgtgatctgcaaacgtggcattccgtttgtggccgaagcgatggaggtgctgggcggcattggttattgcgaggagagcgagctgccgcggctttaccgggagatgccggtaaacagtatttgggaaggttccggcaatattatgtgcctggatgtgctgcgcgttctcaataagcaagcgggcgtatacgacttattgtcggaagcatttgtggaagtgaaagggcaggatcgctattttgatcgcgcggttcgtcgtttacagcagcagctgcgtaagccagctgaagaattggggcgagagattactcatcagctattcctgctgggctgcggtgcgcaaatgttgaaatatgcctttccgccaatggcgcaggcgtggtgtaaggtgatgttagatacgcgcggcggcgtacggttgtcagagcagatccagaatgatttattgctgcgggcgacgggaggagtgtgtttgtaagcgtatacgactgatgcgacgctggtttcgattaactcaatgaaatattttaaaattgtaggccggacaaggcgctcgcgccgcatccggcattgttcatttgctgtagatgacactcacgcatacagtatcgcctgtacgcgccagttatcaggctgctggtcttcgtacatggtaataatgcggtaccatgacgcaccttgttcatcggcctttaacgccacgatacgttccacgtcctgcggatcccctgaaatattgctaactgagatctgacctatttcattcaggcccgtcacgcagtcagcactggcgaattctgcagactgtgccgtggcgctcgcaggataagtcactaattgcagcgagggtgaggcaagtaattgtttcatcgtcagctccatttttcgtttccccacatgttgcagggcattccatcgcggtaataaacgcccgagcttccagccggtaatttattgtgcgcaggtaaacgcatagggacgcaaagcaatgtaaagctgactatgtaagttgtctgatttatttacggtacaaaatggcttgtgaataccactgtcctgtcacgatggtttcgtccaccatgacgacaacgtaataatcagcttttgcagcgacagctttcgctctgatttctgctaatgcgtcatccggagaaccccgaaccatcgtgcttacgctacctattcgctgtaacccttgcgtctggtcgcggcgaatctcttgcggatggtccgttactggcggtgctggctgtggcgtaccttgcagtgcgctacaggcacttaacatcaacaccaataataaactggcaaaccggtaaataacgctattacgtttcctgctaaccatagtgtagtgccttattaatttaactttgggggaatgttcccgaattgttacctggtacgcgattttcgaatgaaaacgtgacgaaagcgtaacccacatctcaacattatgaactaataccgccagcagaaacttgtgctaaggatttcttcatgtcataccagacaaaaaggagagacagatgattgaaatagaatcacgcgagctggcagatattcccgttcttcatgcttatcctgtcgggcaaaaagataccccgttaccgtgtgtgattttttatcacggctttacttcgtccagtctggtgtatagctattttgccgttgcgctggcgcaggctggtttgcgggtgatcatgccggatgcgcccgatcacggtagccgttttagtggcgacgcagcgcggcggttaaatcaattctggcaaatcttgctacaaagtatgcaggaattcactaccttacgtgcggcaatagccgaagaaaactggctgcttgatgaccgtctggcagtcggtggcgcgtcgatgggcgcgatgacggcactgggaattaccgctcgccaccccacgataaaatgtatcgccagcatgatgggatcgggctattttacatcgctcgcccgttcactgtttcaaccgctgatacctgaaacggcagcacagcagaatgaattcaataacattgtcgcgccgctggcagagtgggaagcgacaaaccacctggaacagcttggtgacagacctctactgctgtggcatggccttgacgatgacgtcgtgcctgccgacgaatcactacgtttgcagcaggccttaagcgagacgggacgggataaactgctaacctgttcatggcagccaggtgtgcgtcaccgcattacgcctgaggcgttagatgctgccgtgacatttttccgccagcatctttaaacacgcagaatgctgaccccttgcgcttccagttgttgcaggatttccgggttagcatttttgccagtgatcagcatatcgatttgatcggcacggctaaaaagcattcccgcgcgttcgccaatcttactgctatcaaccagtaccaccagtttccctaccacgctcagcatcttctgctctgccattgccgtcagcatatcggttttatacaacccttctgctgtcagtcctttgccgctggtaaacatccagtgcccggcatagagactgttttcgctgccttgcgggcttaaagtgatggactgacttttgttgtactgtccgcccataatgatcacgctgtcatgctcctgatcgatcaggtaatttgccagcggtagataattagtgatgatttgcactggcttgccacacatttcccgcccaagcagaaacgcggtggagccgcagttgatgactacgctttcgcccggattaaccagctgcgaggccgctttagcaatacgtactttttcatcgtgattctgcgcttgatgcagattcatcggcgtccagcgcgggcgctgttgggtaatagcttctgcgccattgcgcacttttttcagtttgccgctttcgtcaagtttattgatatcgcgtcgtgcagtggcaggcgaaattcccagacgctcaacgactttctcaacggtcacaaagcccaattgtgcgagcatttccaggaggatttgatgtctttgtgcttcagtcatgagctattccgataaaatttgatttttttagatgatatttgaaatagccaggaaatactatgccggatagcgcgagcatctccacgctatccggtacaagcgacagattacaggaacgacttgaacggcagatctggttcaatagtgaagcaatcatcgaaaccacgcggatagtggtactcgaagttgtctttatccagcggccaggtaaatttgccgccgacctgccagataaacggcttgaagccatacttcaggcgatcttttttcatctcccacagcacgcggatctcttgcggatcggcctggaagtttgaccagatatcgtggtggaacgggatcactactttcgcattcagcgcttcgcccatacgcaagatatcagcactggtcattttgtcggtaataccgcgtgggttttcgccgtatgaacctaaagccacgtcgatctgatgctcattaccatgttttgcatagtagttagagtagtgggagtcgccgctgtgatacagggtaccgcctggggttttgaacagatagttcaccgcgcgatcgtccatgccgtccggcagtacgccagccgctttttgatcggcaggcagggtgatcagtgccgtacggtcgaaagcatcaagtgcatgaatttcaatgtcttttaccttcactacgtcgcccggtttaacgacgatgcaacgctctttcggtacgccccagccaatccacaaatcaacgcaagttttcggtccaatgaacggtacgtcatcagcacagttctgcatcacggcagcagcgacgttaacgtcgatatgatcgttgtgatcgtgagtcgccagtaccgcgtcgatctggcgaatcgcaaacggatcaagaacaaacggggtggtgcgcaggtttggctgcagttttttcacgccagccatgcgctgcatctggtgaccctgtttcattaacgggttaccgtggctttgtttgccagtaccgcaccaaaaatcaacacaaacgttggcaccgccttctgatttcaaccagatcccggtacagccgagccaccacattgcgaaagtgccaggtgcgacctgctcttgctcaatttcttcattcagccagctaccccactccgggaaagtgctcaggatccaggactcacgggtgatacttttcactttactcatcgccatttaccttcgtgatagttcaattcgaatcaatatgtgattggttttgattaatcctgacactattttttcaggaaggcaatgaccattttttgactttttagcaggagagttattgtggattttgagtgtggaaagattaaattgaatgtgtaatgcaattaactaaatgaatttaaatgaataaatatttcattatgtgaatcccattctgtttatatggaattatttgcgtgcgacgtcacatttaatcataaataatcttgttgtgattacttttgaaaattagagtgagagcacaacattccgggtgtgcgaaatacccggttacctcttcttcaggagatcgttatggagatcctctacaacatctttaccgtgttttttaaccaggtcatgaccaatgccccgttgttgctgggtattgtgacctgtctgggttacatcctactgcgcaaaagtgtcagcgttattattaaaggtacgattaaaaccataattggtttcatgttgttgcaggcagggtccggcatcctgaccagcaccttcaaaccggtggtggcgaaaatgtccgaagtctacggcattaacggcgcaatttccgatacttacgcgtcgatgatggcaaccattgaacgcatgggcgatgcctatagctgggtgggttacgcggtgttgttagcgctggcgctgaacatctgttacgtgctgctgcgccgaattaccggtattcgcaccatcatgctgactggtcacatcatgttccagcaggcggggctgattgccgttacgctgtttatcttcggctactccatgtggacgaccattatctgcaccgcgattctggtttcgctctactggggcattacctccaacatgatgtacaagccgacacaggaagtcaccgacggctgtggtttctccattggtcaccagcagcagttcgcatcatggattgcttataaagtcgcaccgttcctcggcaaaaaagaggaaagcgttgaagacctcaaactgcctggctggctgaatattttccacgacaacatcgtctccacggcgattgtcatgactatcttctttggtgccattctgctctcctttggtatcgacaccgtgcaggcgatggcaggcaaagtgaactggacggtgtacatcctgcaaaccggtttctcctttgcggtggcgattttcatcatcactcagggcgtgcgcatgtttgtggcggagctctctgaagcattcaacggtatctcccagcgcctgatcccgggtgcggttctggcgattgactgtgcggctatttatagcttcgcgccgaacgccgtggtctggggttttatgtggggcaccatcgggcaactgattgcggttggcatcctggtcgcctgtggctcttcaatcctgattattccaggctttatcccgatgttcttctccaacgccactatcggcgtgttcgctaaccacttcggcggctggcgcgcggcgctgaagatttgcctggtgatggggatgatcgaaatctttggttgcgtctgggcggtgaaactcaccggtatgagcgcctggatgggcatggcggactggtcgattctggcaccgccgatgatgcagggcttcttctccatcggtatcgcctttatggccgtcatcattgtcattgcactggcttatatgttcttcgctggccgcgcactgcgtgcagaagaagatgcagaaaaacaactggcagaacaatctgcttaataaggagttttgattatgaccgtacgtattctggctgtgtgtggtaacggacaaggcagttccatgatcatgaaaatgaaagtggaccagtttttaacccagtcgaacatcgaccacacggtaaacagctgcgcggttggcgaatacaaaagcgagttgagcggtgcggatatcatcatcgcttctacccatattgcgggcgaaatcaccgtgaccggcaacaaatatgtggttggcgtgcgcaacatgctctctcctgctgattttggcccgaaactgctggaagtgatcaaagagcatttcccgcaggacgtgaagtaaggacgcgccatgaaattacgtgattcgctggctgaaaataaatctatccgcctgcaagcggaagcagagacatggcaggacgcagtgaaaatcggcgttgatctgctggtagcggcagatgtggtagagccgcgttactaccaggcgattctggatgcggttgaacagcacggcccgtactttgtgctcgcacccggcctggcaatgccgcacggacgcccggaagagggggttaagaaaactggttttgcgctggtgacgctgaaaaagccgctggagttcaaccacgaagataacgatccggtggatatcctcatcaccatggcggcggttgatgccaacactcaccaggaagtgggcatcatgcagatcgtcaacctgtttgaagatgaagagaatttcgaccgtttacgtgcctgccgtaccgagcaggaagtactggatctcattgaccgcaccaacgcggcagcttaagaaggaattgaacatgtcattaccgatgttgcaagtcgcgctggacaaccagactatggatagcgcctacgaaaccactcgcctgattgccgaagaagtcgacattatcgaagtgggcaccattctttgcgtaggcgaaggcgtgcgtgcggttcgtgacctgaaagcgctgtacccgcacaaaatcgtactggctgacgccaaaattgccgatgcaggcaaaatcctttctcgcatgtgcttcgaagccaacgctgactgggtgaccgtaatttgctgtgcggatatcaacaccgccaaaggcgcgctggacgtggcaaaagagtttaatggcgacgtgcagatcgaattgaccggctactggacctgggaacaggcgcagcagtggcgcgacgcaggcattgggcaggtggtttatcaccgcagccgtgacgcgcaggccgcaggcgtggcatggggcgaagcggacattaccgcgatcaaacgtctttccgatatgggcttcaaagtcaccgtcaccggtggtctggcgctggaagatctgccgttgtttaaaggcattccgattcatgtgtttatcgctggtcgcagcattcgtgatgccgcttctccggtggaggccgcacgtcagttcaaacgttccatcgctgaactgtggggctaaggagcggatatgttgtccaaacaaatcccgcttggcatctacgaaaaagcgctccccgctggggagtgctggctggaacgactgcaactggcaaaaacgttaggcttcgattttgtcgagatgtcagtagatgaaacggacgatcgcctttcgcgcctcgactggagccgcgagcagcgtctggcactggtgaatgcgattgttgaaaccggcgtgcgcgtaccgtccatgtgcctttctgctcatcgtcgtttcccgctgggaagcgaagatgacgcggtgcgggcccaggggctggagattatgcgtaaagctatccagttcgcccaggacgtcggtattcgcgtgatccaactggcgggctatgacgtttactatcaggaagccaataacgaaacgcgtcgtcgttttcgtgacggcctgaaagagagcgttgagatggcgagccgcgcgcaggtcacactggcgatggagatcatggattacccattgatgaactccatcagcaaggcgctgggctacgcacactatctcaacaatccgtggttccagctctacccggatatcggcaacctgtcggcgtgggacaacgacgtgcagatggagttgcaggccggaatcgggcatatcgtcgcggtacatgtgaaagacaccaaacctggcgtcttcaaaaacgtgccgtttggcgaaggcgtagtggatttcgaacgttgcttcgaaacgctcaaacagagtggctattgcgggccgtacctgattgagatgtggagcgaaacggcggaagacccggcggcagaagtagcgaaagcgcgtgattgggtgaaagcgcgcatggccaaagcaggcatggtggaggcggcataatgcaaaagctgaaacagcaggtgtttgaggccaacatggagctgccgcgttacgggttggtgacctttacctggggcaacgtcagcgctattgaccgtgaacgcgggctggtggtgatcaagcccagcggtgtcgcctacgaaaccatgaaagcggacgatatggtagtggtcgatatgagcggcaacgtggtggaaggggagtatcgtccgtcttccgacactgcgacgcatctcgaactctaccgtcgttatccgtcgcttggcggcattgtccatacccactccactcatgccaccgcgtgggcgcaggcggggctggcgatcccagcgttaggcaccacgcacgccgattacttctttggcgatatcccgtgtacgcgtggattaagcaaagaagaggtgcagggtgagtacgaactgaataccggcaaagtgattatcgaaacgctgggtgacgccgagccgctgcatacgccgggaattgtggtgtatcagcacggaccgttcgcctgggggaaagatgcccacgatgcggtgcataacgcggtggtgatggaagaagtggcgaaaatggcgtggattgcgcgtagtattaacccacaactgaatcacatcgacagcttcctgatgaataaacacttcatgcgtaagcacggtcccaacgcttattacgggcagaagtaaaacacgcgctgcggaaatttccttcttcgggagataactggtctaattccgcagccgtttttcaaaaaaagccccctgcgaagggggcaaagcaaactatggcaatgtttcgttggttatacctggtgctagcgataaatatccgcgctggcgtgcatattgccgttactccccggttcccgcatcagaatcacatggtagtacgttgcgccttgcgcatctgtctcttcatttaatgcctgacgtgcttcactctcagtggcgaagttatgattgatataaatcacgcctaagctttgcacatcgtccatatttctggcctggtggttattaatttcaatggctgcccatgtatttgcacttagcaaaagcacagccagaagggctaaaacgcgactgaacatagatacctcctcgacggctgactttgtgtgctctcctcttgtggtgatcttctgatttaattttaatcaatgataaagaagttgatggtgaccatttctgatgcagttgttcaaaaaaacaccatgacgaagtgtgatgaactccaaatcagcggtttagaggttatttgcgaaaggggagatttatttcggctctgcccttgagtttagcggggtatgtcagtactataacgcgtcatttttcagccgacctttaacacgttccttgcctccccgggattcggctgacccagacaggaggctgaataatccgtaaggagcaattcgatgcgtcattacgaaatcgtttttatggtccatcctgaccagagcgaacaggttccgggcatgatcgagcgctacactgctgccatcactggtgcagaaggcaagatccaccgtctggaagactggggccgccgtcagctggcttacccgatcaacaaactgcacaaagcacactacgttctgatgaacgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagagtaatttctgatgaccaaccgtctggtgttgtccggcaccgtgtgcaggactccccttcgaaaggtcagtccatcaggaattcctcactgccagttcgtgcttgagcatcgttctgtgcaggaggaagccggctttcaccggcaggcgtggtgccaaatgcccgttattgttagcggacacgaaaaccaggccattactcacagtataacggtcggcagtcgcataaccgttcaggggttcatttcatgccataaggcaaagaacggactgagcaaaatggttttgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtccctgctgccgtacactgatcgccatcagtaatcggtcacggtccattaatacgactttgagaggataaggtaatgcaagttattctgcttgataaagtagcaaacctgggtagcctgggtgatcaggtaaacgttaaagcgggctatgctcgtaacttcctggtaccgcagggtaaagctgttccagctaccaagaaaaacattgaattcttcgaagcacgtcgcgctgaactggaagctaaactggctgaagttctggcagcagctaatgctcgcgctgagaaaatcaatgcactggaaactgttaccatcgcgtctaaagctggcgacgaaggtaaactgttcggttccatcggtactcgcgacatcgctgacgctgtaactgcagctggcgttgaagtggctaagagcgaagttcgtctgccgaacggcgttctgcgtaccactggcgaacacgaagtgagcttccaggttcacagcgaagtattcgcgaaagtgatcgtaaacgtagtagctgaataattcgttattcaacgagacgtaaaaacgccgaccagtggtcggcgttttgcttttaagcgataaaaaccgcagaaatagacgttccctccataaatctcttgctattccttttataaaaagttcgcagtacccatacctggcccccagcctcgccgctggtagttcgtgtcatgttttttacgcgtaaaacacgacaaaagcatcaatacagcgatcgtctcccttgtatgataataaaaacaatatgttatatatgaatgcgctgttattttattgtttttatatataaaaggataaaatatcatcactttcgtaatcttgaacgctttgcaggtgcgttcaatccaataaatgctaatattatggctatcatagccataaaaagataaaatattatcactatgggtaaaaaaacagcaccgttactcccttatacgaatcagatgcttagtgaatttggtgagcggctgaaacttgctcgtttacgacgcaggcttaccgcaaagcaagttgctgaacgtgctgggatgtcgccaataacattgcgctctctggagtcaggaagtgcaggggtcacgataggggcatatttgtctgtgatgcaggttttgggcctggaaacggatttaaataagcttgcagctgaagacgacttagggcgtcagctccaggattcccgtttgattaaaaaaagagggctttctcgttcatcaggtaaaaatgaagaaggtattcagacagacccttttcaaacgaggtatgagaaagaaggtttactcaccacggatttaacagcactggcagaaggctcaacgccatctattacaggagaaacatcaacctctcttgcagcactattaaaaccgataaaaaaaccgttaaaaggaaattaattatggcattaatcggagtgtatgcggattgggaaggcctggatggtccggagcggattggttatttacacagtcgccgcactcggacgcgtgagatatttgagtttgagtacgataaaaaggcgcttgcagatccttcacttaatttcattcagttagatcctgaaataatgttgtatgagggagcacagtacccaattcctccaaaggataaatttggtgcatttagtgattcctgcccggatcgttgggggcgtatgctaatgaagcgtcgttttgagagggatattcgagacgggttatgtgataaagactcccacctttatgagtctgattatctactaggtgttcatgatctttatcgggttggggctcttcgatacaaacgtgaagacgctggagagtttcttgataatcgcattgatgttgcagccccaccatttaccgaaatagcgagtctggaaagggctagccgggcaattgaagaagatcctgataataaagagctaatggggcaaaaatggttaagaatgctaatcgctccggggggatcattagggggggcacgtccgaaagccagtgttgttgatgaagctgggcatctctacatcgctaaatttcccagtgtaaaagatgagtatgatgttggtggatgggaaatggtcgttaatgcacttgctgttggctgtggactgaatgttgcacctgctcaggcgcataaatttgccagcaattaccattgttttatggttcgtcgttttgaccgcactaatgcgggaaggcgtctgcattttgcttcggctatgacactaaccaggcatcaggatggtgaagatgcctctacaggtgtgagttatctggaattagcagatgttcttatcaggcatggcgcgcagactaatactgatcttaaggaactctggtccaggattgtttttaatattcttgtttctaataccgatgaccatttacgtaatcatggatatatcttgataccgggaaaaggttggcggctttctgaggcatatgatttgaatcctgttgccaggtctgacggtctaaaactcaatattacagaaaatgataatgcacttgatttggaattagctcgagaagttgcggagtattttcgacttggtttgacagaagcagatgacattattgctaattttagagggattgtcagtcagtggcgaatcattgccgagcgtcttcgattacctggtcgtgagcaagagttaatggcagaggcgttcaggggggcaatttagaatagttattttgatatattcgctaaatcataaatttgcgaagcaatgccagtagatactgaacgttttggaagagacgtttaatttatgagaaaaatagaaacgctacaaagctaaattatagcgtttctatgtaaaataattagcttgtcgctaactgtacttgtggttcttcgtctttaactttgataagcatccacagcgcaatggcgccaataatgtcaaagaaagccagggcaataaagaacggcgcgaagccaataatgtgaacgaatgccccgataaacaggttgaaaatcaactgaccgctccatgcacaggctcctgccatacccacagcggtagctacttcgtcttttttgaataggtcaccgcccagagttgctgcaacagtagaaagacattgatgcgagaatgcgccaatgctaatcagtaatacggcgatgtagggattttcgacaatactcaccagaccaatcgtcatcataatgacggctgcaatagtgaaggtaattcttcgtgagttaattaaactcacgccgcgatcgtggaagaacttcgcgacaaaaccactggctaaacagccgagatcgcccagcaggaaaggcagccagacgaacatggcaatttctttcaggctaaaatgcagcgtttcgacgaagaaaatcggtacccagaagttaatggttccccatgccgggtcagcgagaaaacgcgcgatgccaatcccccagaaattacgttggctgaggatatgcttgattgacgttttttctttcttatctgttttaagatgctgttcttgcccagattcaatatagtggcgctcttcatcagaaaggcgtttagcatcttttggatctttataacaaaagaaccaaaataaagccgcgagtaaagcaaggctacctgagacaataaacgcaaattgccagctatgaaacataatgcaccaggcaatcaacggtggagcaagcatcgcgccgagtgaggtgcccatattgaaaacacctgtcgccacgccacgctcttttgccgggaaccatgttgatgcggtttttacacccgcaggaattgccgatgcttcgctgaaacccatcagggcgcgcataaatgccagacctgaccatgttcctgtcaaggcatgccccattgtcgccaggccccagattgcggcacatatcgcaaaacttaacttcagacccacggtatcaataaagaagcccattatcggttgccccaatgtataggccaactggaatgcactgacaatccatgaatattgttctttggttattcctgttgtctccataatcgttggagccgcaatacctaacgccgttctgtccagataattgattacagtgataaagcatacgagggcaatcatatgccatcgataattctttattttattcatttttaaaccttttaattatattaataaaccctggttgttggtatttccatgtaataggcaataaaaatcaggtacagaggaaatattgaaaattattgtgtgtaaatgtctccctttaaaaagtctggccagtttttttcaaagtaaataccgttaatacacggttgcatacgtaaagactttacttcggtaataaaagaaccttgcgaatattgaattgttaatttgtgatttttgtcttcagcgagttcagagcgaaaacgccattcttcttttacgccgcgacgagtttgtggtaggcatttgccttgtggatcaataaccatccgcgccccacgactgccgccacctgcgtcaatataatgcgttaattgcgttaatacggcggcagaagtcagtgccatatgccgccacataaacagctcggcaacttcacccacatgtttgattgccaatccatgccgttggacaaattcgttcaatagcagggcatcacgagtggcacgtcggactttatcggcatggcaaataaatcccgcatagtcagacattcgtgcctgaattttttctctcacaaccgacaacggcatcccggacccgttatcgtgcgcctgagtaatgatctctcttatagaagccagtgccggagctgccagctgtgcaatatctccatcaatattccgcttttgcgtgcaaccaataaagcgcgccagacgaacagcaaaaacctgcccggcattcaatgccgcgccgccaggtcgggtgacgccgtgtgtgccagcaacttcccccaccgcaaaacaaccgggcagagatgtttgtccccagatatcgacttcaatgccgccattcatgtgctgattattcatggcaaactgcaatggctgcgtgatgagatcgtaaccgtgcatcttatacagcgagatagacagaggattcatttgttgcaggcgttcgatgggcgatggtgccagagcgtcgttattttccagatacgcgcgaacgtcgtcgtccagtcgatctaatgagaacggcaggtcacccggcacaggttctggattacgattgaaatccataaataccagacgccctgattgctgctcttgcgctactgccatatctaacaagctggagccaaaatccattacccgcgtggcgtggaacggccactgatagcctttacggaaaatgtttgaagccagctcctgggtggtgcgatagtaatccgcgaggaagttatactcgttgcccccggcatccacggaatagatatatgggatcacctgtacataggtgccggacaaattccacggaaacgtgctgcgcggcgtgcctataccaaactggctttcggtcagattggttagcgtcaggccttcctccagcgccagccccagcgagccaaaacatttgtgtgggtacacactgtcgcgataaagctcgccaggccctcctgttgccagtaccacattgggcgcagtcacaattgccagcccccatgggttatgggcgcgatgaccggtcgcgatgattgcccccgccacacggtcttcaccgttttcgtcacgctgatgcagcagtttaatcactgttgcactggtcaacattgggatagcaagacgctgtacttcttccagcagcactttcaccattaaccttgaggtacgcggcccacacgaggttgcacgcccggcttcgtcgtggtcggtttgataacgaagaatcgcgccatagcgatcttccggtaattccagaccaagatattgcaacccgccaagagtgtgcagagaacctaccgcttcaacataagcggtgtcgtgatccatcgccccaccgctcgccagtgcctctgccagtttggcgaagttgtcgccgttgcccgcggtagcggcggtaaacagtgtttgtttatcagagccagaacatgccgacgtccccatatataacccggcggtggcgattaacacattttgctggcggcgtttaagttctacagctgcacgtagccctgctgcaccactgccgactaccagggcatctgttttccagagtgggtaatcaacaccgtctaccgtgacaacccatgcgggttctgcctgtgcaaaaccctttgggaaagtaacgtgtgtcagtgcatcaaggatggcctcatcaagctggctcatgcatcctccatcggcgtaaacaggctactttccatcaggcgtgggtgcttgataattggacggaaggccatgaatggcagaatgtcgcgctcaatctctacgccaggggcgatctcaattaattcaacgccttctgccgttaactggaatactgcgcgttcagtgatatacaacacttcctgaccactttgctgtgcgtaggcggcgctaaaagtgattttttccacctgggtaaccagtttagggatttgacctgactgggcgatatgcaaaccatctggcgttacatcaatcttgctgcctttggcgtcaaacgtaccgcaaaacaccactttacgggcgttttgtgcaatttcgaggaagccgccggggccaatgagattgccattaagatgggagacgttgacgttaccgtattgatccatctctcccatgccgaggaaggtgatatcgatgccgccgccactgtagaattcaaattgatcgagtgatggaataatggcatcggcgttacgggcgcagccgaacagagcatcatccagcatcatgccgttatgtacaccctgttctacactcagccacaaactttgataaggcacgccttcgcgcagcgcaaccccaggaataccaccgggaataccaaagccaaagttggttgaagcgcctgccgccagttcccgcgctgcccgacgggcaatcaggcgacgcaccggatgactaaccagttcaatagcgtcgttagaacttagacggcgatgttgaccgctaatggtcaggtcgtaaccaccaagataggtttgcggttgttcgcggtgctcaacgataccatcgaccagaatccccggtagcttgaccttgcgaggttcaatggtgccagcttccagtacatcgcgcacctgtacaaacactttgccgccactgttgtgtgctgccagcgccatcgaatagctatccatatcaatcgcttcttcttcgaggctaacgttgccacgcggatcggcataggtgccgcgcaaaatcgcgtagtccactttgaaagggcgatagcggagtttggtttcaccgtcgatttcaatcagttctaccaaatcctcggtagtgcattcgttcgacttaccgccgccattgcgtggatcaacaaacgatcccagcccaacgtgggtaaaaagtcccggacgtccggcaccgatctcccgcagcagtgcctgaattacgccaccagggaaacagtaggcttcaatagcattgcttttcaccagttcctgcatcttgggcgaccaggtaaaatgtccggcaataatgcgtttgagcatttcggcgtgagcaaaacggttagtgcctttgctgtcgcgatcgccaatacccagcgagtggattaatgtcagatcgcgcgggtgtccggtttgcaggaaacgctcttcaatggcggccataatatggtcagcttccaccataccgccgccgttaccgctaatggcaatggttgcgccgtcctgaatttgcgccgccagtgtctcggcggttgataacttacgcatacaatttccttattgattgtggaagctcacgccggctttttcggcaaatgcgtgcgtcgcctgttggcaatcctgagtggcggacattaatccagccagtaactggtgggagtaatcggcgtgtttattttccagcgccagaatcagttgcttaatatgtgccagtgccaccggaccacatttttccagctgcgctaactggttcgccatccagctttccacctgttctttttctaccacttcatcaattaaattcgccacctgggcttcctgcgccgtcaggcgtttacccagcatcagcatctggcgaccgaccacaggaccaacctgattaagcactcgctcaatgcccatccagcctggcaccatgccgagcatcacttccgggttagagaatttcgcgccggggcgagcgatacgaatatcgcagcacaaggcaagttcaataccgccaccgatggtatgaccgttgagattcgcaacggttaattggggtaagttgcgcaggcgattaaaaacgtcattaccgcgtttaatccattttctgcccatatctaatggcgaataggccgaccacgatttaatatcgccgcccgcacaaaagaatttatcgccggttgccgttaattcgactaagcgtaatgccgtgtcattttcaatttcatttaaataatggtcgagagattcgatcatttcttcattaatagcatgacatttatcttcacggttcaatgtcaggcggcaagaagccgccgctctgctgaacagaacgggttggtcactcatgattattccttaacaataatgtgcgatgcgatcgacgctaatatccagcgtgctgttaatatctttctgccaccagtacggtgagaatatttccagttcaatagcgccattaaatccggcgttttcaaccagccgacgaattgacggaatattgatgacaccatctcccggcattcacggtcattgaccagatcggtggtcggcactaaccagtcggaaacatgaaacgcgaggatgcgttttccggcacgcaggatctgactggcgagatccgggtcccaccagacatggtagacatctaccgccacgccgaggccaaattcgccatcgggatcgagttcatcacaccagtccagcgcctgacgtaacgtgcacagacaagaacgatcggcagcagtcatcgggtgcagtggctccagtgcaattggcacgccgacctctttcgaatgtggcagcaactggcgaatcccttgtttcacctgttcccgtgcttcgtacagatcttttgttcccattggcagaccgccaaccacctgcatataacaggcggcgttcagtacagcggcgtcgtccagcgcccggcggttatcgtcaatcgccagtttgcgctccgccagcgtcggtgcggtgtagtaggtgctacggcacaaaccggaaacgttcatgttactggcagcaagctggcgggcgatttgctggagatcttcactctgcaactccctgcgccagggggcaatcgcgccaataccgcgtgcggcgcaggcatcaataatggcgggtagcggcgttttatagcccagtgtcgcggtattgatactgaataaatccgggcgttgtaacagatctctcatgattcagcctcagaagcgcggcatacttaagccaccgtcaatggcgaccgcctgaccacaggtgtaaataagtttaccttccgccatcgcgcggacagtggaagcaatatccgccggataaccccaacgtccccacggcaccagacctttggcaatcagttcgtcgtaataggccgttgccggaatagtcatatcggttttgatgagaccaggacgcacttcatatacgccaatttgttcattacaaaggcgagcagcaaacagacgagcagcggcagagacggcagttttggcaatggtatattcgccgcgattcatcgccagcatgatggcgttgatggaactgacgaaaataatcgagcggtgcggcagttctgcttccggtttcggctgtgccagtaagcgcttactgaatgcctgagcaaggaagaacggtgcgcgggtgttaatggcaatattttggtcgaagctgtctggttcgaggtcgagaaggtcaccgcgttttttcactgaaatgcctgcgttgttgagcaggcagtccagacgtccccactggttttgcgctgcgtcgagcatctcttcatgcagggagagatcgcccacatcagcagggaagcaaatcacttccacgccttccgccagacattcttgttgtgtggcatgtaatttttctacgctatcggcatccggacgatcattaatcagcagattaaatccgccacgcgcaagctccagcgcacagccctttccaataccacgagcggctccggtaatcacggcaacaggacgagtggatttcatacaatagctctcttttttgaattttgtttccttagtgatgattagcttgcgactggaggataaaaagatcaaccatctagttggttgatatgcgatggcgatcacaggacatttgataacctgatgaaagtacaagtttttgcccttttttctgaagctgaaatcaaatcaggttatgatagtcaccacgaagaggtcgtggggaagcgttatgtatcttgataccagcaacgtacagagcctgaaagaaaagctgctgttatgcgcggttaatgaatttgccgaatatggttacgaaggggccagagtcgataatatcgtcaaggccgcggggtgcagtaaacagacggtttatcaccactttggtaataaagaaaatttatttatcgaagtactggaatatacctggaacgatattcgacaaaaagaaaaggcccttgatttctcagatcttccgccacagaaagccattgagaaaataatcgattttacatgggattattatatttctaatccctggtttttaaaaattgtgcatagtgaaaatcaaagtaagggtgtgcattatgcaaaatcacagcgtcttttagaaattaaccatgcgcacttgcagttaatggaatccttattggatgaagggaagaaacaaaatatttttaagccagatatcgacccattgcaggtgaatattaatattgctgcgcttgggggatattatttgatcaaccagcatacgcttggcctggtttatcacatcagtatggtttcaccgcaggcactggaagccagacgtaaggtcatcaaagagacgatccttagctggcttttggttgacccttcatctaccgcgcgcgaataaaactgccatccggctggcgggtaaacaggacctgttgattattccccgtatcaatggttaagcccgtcaccacgccgctggcgttctggcggattttcaccatctgcccgttttgcaaattactcagtggcttatccgcgccttctacctgcgccatggcatagacatcggtagcgggcagtccgtggtcgcggaacagctgcgccatcgttttaccgggttcgacacgataggagcgccattgattatcaattccgctatctggctggaatggttgcgtatgggtggtttgcggctgctcttctggttggccttcctgtattggttctggagcgaccggagccacctgatcaggatcattttgtggcgtgactaattgcgcccgcagctgttcttctgtcggtggttgtgattgcgactgaatatctaactgtgcttcacgcgtcaccaccggcgcgttgggcgtatcatcagatggaagcagaaatccgaccaccaatacaatggcggcaataatgatcccccgacgatgcatcggcggcagcgggtccatgaagcgaaaattgtccggcgcgtgccagactttctccagggttggttttagttcaaagcgcccgggcatggtttcctcctgctccgcgtcttgttcctcaatcatagcctatgaataagctaacgctatgatgtccgtggtaaacccgcctttattatattcatacgggatattgctattgtttctttttccccgggatttgtcatcattcccgcgacaaagttttacccaaagaagtgtggctgatatgctgcccgctactttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggcattgccgatgcgctggaaggcaaacatccggctgttccggttgatgtggtgcaccgcgcgctgcgtgaaatccacgaacgcgccgatgccgttcgtcgtcagcgtttccaggcgatggctgctgaaggtgtgaaatacctggaagaaaacgccaaaaaagaaggtgtaaatagcaccgaatctggcctgcaattccgcgtgatcaaccagggtgaaggcgcaattccggcacgtaccgaccgcgttcgtgttcattacaccggaaaactgatcgacggcaccgtgtttgacagctccgttgctcgcggcgagccagctgaattcccggttaatggtgtgatccctggctggattgaagcactgactctgatgccggtaggttctaaatgggaactgactatcccgcaggaactggcatatggcgagcgtggcgcaggcgcgtccatccctccgttcagcaccctggtgtttgaagtcgaactgctggaaatcctctaagcagcgcattctgttcccctcgaaccagaggggagcaggcattcagcaataaacccttcagtttgccaaacggcgctattttatgttgtaaagtccctgtaagcgtgtatttttgtgagctgtttcgcgttatcaccgtgatatgacactcactttaaacataaaattaacattagatctaaatcttagtattcatcccgcgtattgttacctaatatcgatgagtcccgatacagattcgtcgtatcatagactgactaaaggccgtagagcctgaacaacacagacaggtacaggaagaaaaaaacatggtagatcaggtaaaagtcgttgccgatgatcaggctccggctgaacagtcgctacggcgcaatctcacaaaccgacatattcagcttattgccattggcggtgccattggtacagggctgtttatggggtccggcaaaacgattagccttgccgggccgtcgatcattttcgtttatatgatcatcggttttatgctctttttcgtgatgcgggcaatgggggrattgctgctttcgaatctggaatacaaatcttttagtgacttcgcttccgatttactcgggccgtgggcaggatatttcaccggctggacttactggttctgctgggttgtaaccggtatggcagacgtggttgccattaccgcctatgcgcaattctggttccctgggctttctgactgggttgcttcgttatccgtgatcattctgttactggttctaaacctcgccacggtaaaaatgttcggtgagatggagttctggtttgcgatgatcaaaatcgtcgccatcgtgtcgctgattgttgtcggcctggtcatggtggcgatgcactttcagtcaccgaccggtgtggaagcatcatttgcacatttgtggaatgacggcggctggttcccgaaaggcttaagcggcttctttgccggattccagatagcggtttttgctttcgtggggattgagctggtaggtacaacagctgcggaaaccaaagatccggagaaatcactgccacgcgcgattaactccattccgatccgtatcattatgttctacgtcttctcgctgattgtgattatgtccgtgacgccgtggagttcggtagtcccggagaaaagcccgttcgttgaactgtttgtgttggtaggtttgcctgcggctgccagcgtgatcaactttgtggtgctgacctctgcggcgtcttccgctaacagcggtgtcttctctaccagccgtatgctgtttggcctggcccaggaaggtgtggcaccgaaagcgttcgctaaactctctaagcgcgcagtacccgcgaaagggctgaccttctcttgtatctgtctgctcggcggcgtggtgatgttgtatgtgaatcccagcgtgattggcgcgttcacgatgattacaaccgtttccgcgattctgtttatgtttgtctggacgattatcctttgctcgtacctggtgtatcgcaaacagcgtcctcatctgcatgagaagtcgatctacaagatgccactcggcaagctgatgtgctgggtatgtatggcgttctttgtgtttgttctggtgttgttgacactggaagatgacacccgccaggcgctgctggttaccccgctgtggtttatcgcgctggggctgggctggctgtttattggtaagaagcgggctgctgaactgcggaaataaccgcattatcatgctggatggcgcaatgccatccagcttttagatcactcacccgccagcgcgcgcgggaatagtacattgttttccagactgatgtgctccatcaggtcatcaatcagttcattaatgccgttatacatcgctttccaggtggtgcaggcttccggcggcggtgtgacgttattggtggtgtgtttgatcacttccagcagttcgcccgcttcatcgtgctcgctttccattacgctgattggccccattgcctggctgcccatgccttgtttaatcatcgggaagagaatttgctcttctttcatcatgtggctggaaagctcttcatgcagcatagtcaggtattttgtcagcccttttggcacgctcggtttgtcggcgtgaacgcgctcgactttagtcgcttgcaggatcagctccggcagctgctcgcgatggcgatcgtgatagcgcacaataatgtggtcgatgatttccgccagcggcgcgctacgccagtctttttcaatcggttgttcagcaagctttgccagttcggcttcaatgacgtcaacatccagttctttacgtgccgccgcgcgcgccagcgtctgcttaccgccacagcagtaatccatatcatatttacgaaacagagccgaagcgcgaggaatagagagcgccagttcacctaaaggttggtcgcgataagccatagctgatacctcattcttaataagataagatgtattttaaatgcatctttaaaacaaaagctataacccttacgtagcagaggcttatttaactcactgccagcgtgtcaactttctgagacagattcagttaaaggtttttctggttttgctctgaccgcaatgaccacgccaatcactaacagcgcgataccgctcagcgtcattagcggcggcatttgctggcggagtaaaaaggtgtacagcaaacctgccagcgtttcgaaaacaatcagcggcccgagaatcactgtcggtaatcgctggctggcgacgttccagcagagtgcgccaatccatgagcaaagcacggctatcgcaaccatcagactaataaacaccagcggacgggggccaaagggtaaggagaagtccggcgtttgcatattcagccagtaacaggcgacgagatagccgatgagagaaaccggcagcgtgaccagcgcctgcgccgtcgcccacatcatcggatgtttgtcgggattttcccgcagccagcgggcgttgcgcagggcataccatgcccagcagaccacggaaactaacgccagcacgatgcctgaggtataacgtgcccagtcaaaatcggggagtccgtggtttaactcagcaatattcacacacgccaggccgatgccaatacaaaccagtgccggggcgagttttccccacgcgagtttgccgtcgcgctggctataaagcagattggcaaaaacgggaatcaccaccggcagggtgccgataatcatcgtggaaacaggcgcgccagtacgttgaatggcactggcaaggcagaagtaatagataaggttgcccatcatggtgagcatcaaggcggtaagccagtcgcgacgtgccaactgacgcagacgcacgcgtcccagccaggcaatgggcagcgcaattaaccctagcgccaggtaacgccccatcgactgcaacatcgccgggtattccggtacgatcaacggcccgacaaaaataagcccccacatcaaccctgctaacagggcgtacagcacgccgctaatcattactggcatccattggtctgtcagaagaaagttcaggaagcagacatgattgctcccggcatcccgtcattatcagagaggatgcgggaggatgccactttaattaactagttattaacattaaaaagatggcttacgctttcggctaacgttgtcgttgggcggccaatcaatttgctaagcgttttgctgtcatcaaacagaccgcctttcgatgcgccaacgtcagaatccgccagcatatccgccagtccatcaggcagtccgacgcttttcagtgccgcagcgaaatcggcttcgctcaggttttgataggtaatcggtttgccgctctgtttggtgagttctgccgctaactgtgtcagtgtccaggcactatcgcccgccagttcgtaaaccttgccttcatgaccggcttcgctaattacgcgcgccgcagctaccgcataatcagcccgcgttgctgaggcaatcttgccatcgcccgcggcaccgataaatacgccgtgttccagtgctgccggggcgctggcgaggtagttttcggtgtaccagccgttgcgcagcagagtgtaaacgatgccagaatcagccagcattttctccgtctcgatgtgctcatcggcgaggccgagcggggaggaatcggcatgtagcaggctggtataagcgataaatttcacgtcggccgcctttgcggcattaataacattacgatgctgcggggcacgttgacccacttcgctggaagagatcagcagtagtttttccactccctgaagcgcagatgtcagtgcggcttcatcgccgtaatcagcctgacgcacggtaatgccttgtgctgtcagtacctgtgcttttgccggattacgaacgatagccactatttggctggcaggaaccgttttcatcaaggattcaataacatagtgaccaagttggccagtggcaccagtaatagcgatcatgggaagtctccatcgttttgtcttgtgtttaaatacgctaacacttaaacttacttttagtaagtacgtacaaaaaggtaagtatgaaatgagtcaggttagcctgtcgcaacaactcaaagagggaaatctcttcgctgaacagtgtccgtcgcgcgaggttttgaaacacgtcaccagccgttggggggtgttgattctggtggcgctacgcgaaggtactcatcgctttagcgacctgcggcgcaaaatcggcggggtgagtgaaaagatgcttgcgcagtcgttacaggcgctagagcaggatggttttcttaaccgtatcgcgtatccggtggtgccgccgcatgtggaatatagcctcacgccgctgggcgagcaggtgagcgaaaaggttgctgcactggcggactggattgagttgaatttgcccgaggtgttagcggtgcgggatgaacgtgcggcataactgccggatgcgctgcgcttatccggactacggttcatggcttgtagggcggataagatgcgtcagcatcgcatccgccaataaatgccggatgcggttgatgatttgtaggccgaaaaagaagtgttttacttactcagatccacctgataaatcgcaaacccgatatcatcggtcgcgactttattcatcggatactgccctttctctttaataaacgctgcggctttatctgacggagaggtttcgaaacggatatccagtttcttatcgccagctatcggtgctaaacgccagttgttatctgccgccgggtgaatttcccccgcacgtttcgactcatcagcaatccacgctgccagcaccgagcggttctcatccggtgaagcaaaagcgatatggctgtcgcccgtaccggcaaatttgccgccgtaagcgcgatagttattggtggcaacgaggaacatggcgttcggatcaatcggcttgccgttaaaggtcaggttcttaatcctttccgcattggcattaatcatctggcactcgccgtcataacgggcgggctgggtaacatcaatctgataattcacaccatcaataacatcaaagttataggtgcggaaaccatcccagttgatgagtgactgtggtttcgtgctgttaggatcaatctggttaaactgtccggcggagcactccagccactctttcacctctttaccgctggctttcaccacaatcagcgtattggggtagagataaagatcggcggcattacggaaggtcaactggcctttttccacctccacatagcttgcggggtcatttttgcgaccaccaactttaaacggtgcggcagctgaaagcactggcagttttgccagatccggatcgccctgaatgtaatgctcgacatacgctttttgcgcgttgttcaccacctgcacggtcggatcgtcctgcacaagcgccagatagctatacatattgtcggcagatttaccgattggcttgctgacgaactggcgtgtggcatcgtgatcggctttgagtgtttctaccagcttgctgtcttccgccgcgagggattttttattcgcgatgtcgtaaatcggccgtgcttccgctttcgcctgcgtcacctgccatttaccgctgtcattactgagttgtaagtcgaccacaccaagatgatcgccccacatgcctggcattaccgccggaacaccattcagcgtgcctttcgcgatatcagccccttcgatatcagcaaaatctttacctgggaaaacggcgtgagcatggccaaacataatggcgttaacgcccggaatttcactgaggtaataaactgagttttccgccatcactttatacggatcggcagacagcccggaatgcgccagaacgacaacgacatcggcacctttctcgcgcatttcaggcacgtatttgcgcacggtttcggtaatatcattcaccgtcactttcccggataaattagctttatcccagcccatgatttgtggcgggacgacgccaatataaccaatcttcagcgtctgtttttttccgtctttatcgaccacttcggtgtctttaattaaatacggtgtaaacattggctgtttggttctggcgtcaatgacgttggcatttacataagggaatttcgctcccgccagcgcatttttcagataatccagaccgtagttaaactcgtggttgccaagcgtgccgacggtatagtccagcgtatttaatgccttatagaccgggtgaatatcacctgcttttaatcctttcgccgacatgtaatctgccagcggactcccctgaatcaaatcgccgttatcgaccagtacgctgtttttcacttcattgcgggcatcgttaatcaggcttgccgtacgtaccagtccgaatttttccgtggcggtgtctttgtaataatcgaaatccatcatgttgctatgcagatcagtggtttccatgatacgcagatcgaccgtcgctgcattcacactggcggcaatcagcgtggccaggagcgttgcgctaaacttaatcatcagggacatccttttatcatcgggaatacgaaagaaaagggagaataaacgtcttacttatagaacagtgaagaatgccacaattttacgctttgaaaatgatgacactatcacagttggcgcattcattaacgatagggtataagtaaaacaataagttaacaccgctcacagagacgaggtggagaaatgttagatcaagtatgccagcttgcacggaatgcaggcgatgccattatgcaggtctacgacgggacgaaaccgatggacgtcgtcagcaaagcggacaattctccggtaacggcagcggatattgccgctcacaccgttatcatggacggtttacgtacgctgacaccggatattccggtcctttctgaagaagatcctcccggttgggaagtccgtcagcactggcagcgttactggctggtagacccgctggatggtactaaagagtttattaaacgtaatggcgaattcaccgttaacattgcgctcatcgaccacggcaaaccgattttaggtgtggtgtatgcgccggtaatgaacgtaatgtacagcgcggcagaaggcaaagcctggaaagaagagtgcggtgtgcgcaagcagattcaggtccgcgatgcgcgcccgccgctggtggtgatcagccgttcccatgcagatgcggagctgaaagagtatctgcaacagcttggcgaacatcagaccacgtccatcggctcttcgctgaaattctgcctggtggcggaaggacaggcgcagctgtacccgcgtttcgggccaacgaatatttgggataccgccgctggtcatgctgtggctgcagctgccggagcgcacgttcacgactggcagggtaaaccgctggattacactccgcgcgagtcgttcctgaatccggggttcagagtgtctatttattaattaatttatgcagcaggtccatcacttgctgcacctcttcctgagtaagcgccccgtctttggcccattgcacgcgaccgtctttatccagcaccactacagcggaacttttttcatccagctgccaggcaccgcgtgcgacgccattgctatcaacaataaactgcgaccagggataaagctttttattactctccagactgctgcgcacaaacatccctgaacccggaatcgcgtcgtcggtgttaacaatggtggtggtctggtaacgatcgtgcggtaacttcgctgatttaatcgcttcaatcagcgtcgcgtttttctcttttgcagaggtgcgaccagcaatatgttgcagtactcgcacttttcccactaactgcgcgctgttccaggttttgtagctaaactgatctttatcaagcaccaactcgccacgatcggtgatgccaatcggcggcactcgctgaccggtttcgaactgatgtgcggaagccatcatcggcaacagcaggcaggtgagtgccagaatcttgcgtagggtcatggtgtttccttcttatgatatgcaggtgatccgaccacttgggtctgagttttaatcatatgtgctatttatcgaatttcccgcaagtgtgatgccagtttgcggtcaagcgcacaaatcatatgaaaaatgaatgcttatactgaagaccgcgcttcggtaaaaagataattctgaataattgtaacctttaggtaaaaaaagttatacgcggtggaaacattgcccggatagtctatagtcactaggcattaaaatttgcgcctcataatagttgggccgattgtggcaccgcaaaggcgtaatactcagcaggagataacaatgaaaattttccaacggtacaacccacttcaggtggcgaagtacgtaaagatcctgttccgtggacggttatacatcaaggacgttggcgcttttgaatttgataagggtaagattcttatcccaaaagtgaaggataagctgcatttgtcagtgatgtccgaagttaaccgtcaggttatgcgtctgcaaacagagatggcttaaccaaagtgctatgcagtaaaaagtgctatgcagtaataagacggctcctgattcaggagccgttgatgtttctggggttatgcgacgctttcttctttatctttagcgtcaggcagttttggcgaaagggcggtggctttgctgtcgattcgggtcaccagcagctggtcgatgcggtagttatcgatatccaccacttcaaatttgtagccggcgaatttcaccgaatcggtgcgtttcgggatcttacgcagcataaacatcataaagccgccgatggtttcgtagttgcccgactgcgggaactcgtcaatatccagcacgcgcatgacgtcgtcaataggcgtgccgccgtctatcagccatgagttctcatcacgggcgacaatttgctcttccagcccctggccgaccagatcgcccatcagtgtggtcatcacgtcgttgagggtgatgatccccactaccagcgcgtactcgttcatgatcaccgcgaagtcttcacctgcggttttaaaactttccaacgcctctgaaagggttaacgtatccggcacaatcagcgtgttgcgaatttgtacgccgctgttcagtgccaggctttggttagccagcacgcggttcagcaggtctttagaatcgacatagccgatgatgtggtcaatatcttcattacagacgagaaacttagagtgcggatgttccgcaaccttattcttcagactttgctcatcttcgtggagatcaaaccaaatcacgttttcacgcggtgtcattgaagacggaacggtacgggattccagctcaaagacgttttcaatcagctcgtgttcctgtttacgtaacacgcccgccagcgcaccggcttccactaccgcgtagatatcatcagaagtgatgtcatctttacgtaccattggcagtttgaaaatacggaagattatgttcgccagtccgttgaagaaccacaccagcggggtgcaaacgtacaggcagaagcgcatcgggttgatgatacgcaaagccacagcttctggcgcaatcataccgatgcgtttcggggttaaatccgcaaacaggataaacatgccagtcactaacgagaaagagagaataaagctcagttgctcagagagttctgccgacatatagcgggagaacaggctgtgaaaagctggagaaaatgccgcatcaccgacgataccgccgagaatcgccactgcgttcagaccgatctggaccacggtaaagaacatgccgggattttcctgcatattcaaaacgcgttgggcatttatattgccttcatcagccagcagtttaagtttgattttgcgtgaggcggcaagcgagatctcggacatcgagaagaacgcacttacagcgatcaaacagagtatgactaaaatactgtttaacatatcttatccgacctttcaggccagatcctcggaaggggaagttgattaatttgtgtgaaatacacattgaaagccgattcgaagaaagtgaaccggcattttcagtggctagtatagcgtaaggtactgtaaagccgccagagggttaaaattcagacagctgaaaaatgaaaaactgcctgatgcgctatgccgaacaggcctacgcagtccccgcaatatattgaatttggacgattttgtaggcctggcattttgtttacgccgtatccggcataaacaaaatgcactttatcaacaatctacatttgtacccgtaacgctatgcttccggcggcagacagacgccaattccgccaattccacagtaaccatacgggtttttatgcagatattgctggtggtcatcttcggcataataaaacggtgtggcgttagcgatttccgtggtgatgcgacgatcgtcatcggcggcaagcatcgccgcctgaaaacgttccagactggcgcgagcggcggcatcctgttctggggtcagcggataaatcgctgaacgatactgcgtgccgtggtcattgccctgacgcattccctgggcgggatcgtgattctcccaaaatacttgtagcaactgctcatagctgatgacggatggatcgtaaacaatgcgcaccgcttcggcatggccagtatcgccggagcacacttcccgataagtcggatttggcgtatagccgccggtatagcctgcggcggtgctgtaaacgccgggtaactgccagaacagacgctccacaccccagaaacaacccatcgcaaaaatggcaatctccattccgtcaggtacattggtcattgagtggccgttgaccgcatgcagtgtggctacgggcatcggggtgttacgtccaggcagggcatcggcgggggaaaccagatgctttttatcaaataaactcatggtgtcgctctcccgaaaatcggtcattggggttaaggttgtaacaagaggcgtatttgcacacaataaccaccgtgaataggtctaaagtaaaacataagaaatattttgggtttagtctgctttttaatccatattactggatttttgttaagccgtttaacggcgttccaggggcaggaaaaaaggatattcaggagaaaatgtgcgctatatccgacagttatgctgtgtaagcttactctgcttaagcggatctgccgtcgccgcgaacgtccgtctacaggtcgaggggttatcgggacagctggaaaagaacgttcgcgcgcagctttctacgattgaaagtgatgaagtgacgccagaccgtcgctttcgcgcacgcgtcgatgatgccatccgcgaaggtctgaaagcgctgggctattaccagccgaccattgaatttgatctccgtccaccgccaaagaaagggcggcaggtattgatcgccaaagtcacgccaggcgtgccggtgttaattggcggcaccgatgtggtattgcgcggcggcgcgcggaccgataaagactatttgaaattgctcgatactcgcccggctattggtacggtactgaaccagggcgattatgaaaatttcaaaaagtccttaaccagcattgcgttgcgtaaaggttatttcgatagcgaatttaccaaagcgcagctgggcattgcgctcggcctgcataaagccttctgggatattgattataacagtggcgaacgttaccgctttgggcatgtgacctttgaaggatcacaaatccgcgatgaatacctgcaaaatctggtgccgtttaaagagggcgatgagtacgaatcgaaagatctggcagaactgaaccgtcgactttctgctaccggctggtttaactcggtggtggtggctccacaatttgataaagcgcgcgaaacgaaagtattaccattgacgggcgtggtttcgccgcgaacagaaaacaccatcgaaaccggcgtcggttactctacggacgtgggaccgcgcgtgaaagcgacgtggaaaaagccgtggatgaactcttacggtcacagtttgaccaccagtaccagtatttccgcgccggaacagatcctcgacttcagctataaaatgccgctgctgaagaatccgctggaacaatattatttggtgcagggcggttttaagcgcactgacctgaacgataccgagtctgactccactacgctggtggcttctcgctactgggatctctccagcggctggcagcgtgccattaacctgcgctggagtttcgaccactttacccagggtgaaattaccaacaccacgatgctgttttatcctggggtgatgattagccgcacgcgttctcgtggtggcctgatgccaacctggggcgactcgcaacgctactctatcgactactccaacacggcctggggctcggatgttgatttctccgttttccaggcgcagaacgtctggatccgcacactgtacgatcgccatcgttttgtgacacgcggcacgctgggctggattgaaaccggtgatttcgacaaagtaccgccggatctgcgtttcttcgccgggggcgatcgcagtattcgcggctacaaatacaaatctatcgccccgaaatacgccaacggtgacctgaaaggggcctcgaagctgataaccggatcgctggaataccagtacaacgtgaccggaaaatggtggggcgcggtgtttgtcgatagcggcgaagcggtaagcgatattcgccgcagcgactttaaaaccggtaccggtgtcggcgtgcgctgggaatcgccggtcgggccaatcaaactcgattttgccgtgccggtcgcggataaagacgaacacgggttacagttttacatcggtctggggccagaattatgagtttatggaaaaaaatcagcctcggcgtggttatcgttatcttactgttgctgggatcggtggcgtttctggtgggcaccaccagcggcctgcatctggtatttaaagcggcggatcgctgggtgccaggactggatattggcaaggtcaccggcggctggcgcgatctcaccttgtctgacgttcgttatgagcagccaggcgtggcggtaaaagcgggcaatctgcatctggcggtcgggcttgagtgcctgtggaacagtagcgtttgtattaatgatctggcgctgaaagacattcaggtcaacatcgacagtaaaaaaatgcctccttctgaacaggttgaagaagaggaagatagcggtccgctggatctctccacgccgtatcccattaccctgacacgggtggcgctggacaacgtcaacatcaagattgatgacaccacggtatcggtgatggacttcacctccggcctcaactggcaggagaaaaccctgaccctgaaaccgacatcgctgaaaggcctgttgattgctttgccgaaagtggcggaagcggcgcaggaagaagtggtcgaaccgaaaattgaaaatccacagccggaggaaaagccgctcggcgaaacgctgaaagatctcttttctcgcccggtattgccggaaatgaccgacgtgcatttgccgcttaacctgaacattgaagagtttaagggcgagcagctgcgcgtgacgggcgacacggacatcaccgtgagcaccatgctgctgaaagtgagcagcattgacggcaatactaaactggacgccctggatatcgactccagtcaagggatcgtcaacgccagcggcacggcgcagctgtcagacaactggccggtggatatcaccctcaacagcacactgaacgtggagccgttgaaaggtgaaaaggtgaagctgaaagtgggcggtgcgctgcgcgaacagctggagataggcgttaacctttccggtccggtggatatggatttacgcgcccagacgcgactggcggaagccggattgccgctcaacgtggaagtgaacagcaaacagctttactggccgttcactggtgagaagcagtatcaggcggatgatctgaaactgaaacttaccggcaaaatgaccgattacacgctctctatgcgcacggctgttaagggccaggagatcccgccagccaccattacccttgatgccaaaggtaatgaacagcaggtcaatctcgacaaacttaccgtcgcggcgctggaagggaaaacggaacttaaggcgttgctcgactggcagcaggccattagttggcgcggtgagctaacgcttaacggcattaacaccgccaaagagatcccggagtggccgtcgaaactcaatggcttgattaaaacccgcggtagcctgtacggcggcacctggcagatggaggtgccagaactgaagctgaccggtaacgtcaaacagaacaaagtgaacgttgacggcacgctgaaaggcaacagttatatgcagtggatgatcccagggctgcatctggaactggggccaaacagtgccgaagtgaaaggcgagctgggggtaaaagatctcaatcttgatgccaccatcaacgcgccggggctggataacgcgctgccggggcttggcggtacagcgaaagggctggtgaaagtacgcggcacggtggaagcgccacaactactggcagatatcaccgcgcgcggcctgcgctggcaggaactttccgtggcgcaggttcgcgtggaaggcgacattaaatccaccgatcagatcgccgggaaactcgacgtacgcgttgagcaaatttcgcaaccggatgtaaatatcaacctcgtcaccctgaatgccaaaggcagtgaaaagcagcacgagctacagttgcggattcagggcgagcctgtctccgggcagcttaatctggcaggaagttttgatcgcaaagaagaacgctggaagggaactcttagcaatacccgcttccagacgccggtcggcccgtggtcgctgacccgcgatattgcgctggattaccgcaataaggagcaaaaaatcagcatcgggccacactgctggcttaacccgaatgcggaactgtgcgtgccgcaaactatcgatgcgggtgccgaagggcgtgtggtggtgaatctcaaccgcttcgacctggccatgctgaaaccatttatgccagaaaccactcaggccagcggtatcttcacgggtaaagcggacgttgcctgggacaccacgaaagaggggctgccgcagggcagtatcaccctttcggggcgtaatgtgcaggtgacgcaaaccgtcaacgatgcggcgctgcccgtggcgtttcagacgctgaatctgacggcggagttgcgtaacaaccgtgccgaattgggctggaccatccgcctgaccaataacggccagtttgatggtcaggtgcaggtgaccgatccgcaaggccgccgtaatcttggtggcaacgtcaatatccgtaacttcaaccttgcgatgataaaccccatctttacccgtggggaaaaagccgcggggatggtgagtgccaacttgcgtctgggtggtgatgtgcaaagcccgcagttgtttggtcagcttcaggttacgggggtggatatcgacggcaactttatgccgtttgatatgcaaccgagccagcttgcggtcaactttaacggtatgcgctcgacgcttgcaggtaccgtgcggacccagcagggtgaaatctacctgaacggtgatgccgactggagccagattgaaaactggcgggcgcgggtaacagcgaagggcagtaaagtgcgtatcaccgtgccgccgatggtacgaatggatgtatcgccagatgttgtattcgaggctacaccaaacctgtttaccctcgatggtcgcgtggatgttccgtgggcgcgcatcgtggtgcacgatctgccggaaagcgcagtaggcgtttccagcgatgtggtgatgcttaacgataacctgcaaccggaagagccgaaaacggcgtcgattccgattaacagtaacctgactgtccacgttggcaacaatgtgcgcattgacgcctttggcctgaaagcgcggctgacgggcgatctcaacgtcgttcaggacaaacaagggctgggcctgaacgggcagatcaacatccctgaagggcgcttccatgcctatggtcaggatctgattgtgcgtgagggtgagctactgttctctggtccgccagatcaaccgtatcttaatatcgaagctattcgtaacccggatgctacagaagacgacgtcatcgccggagttcgcgtcactggtctggcggacgaaccgaaagcggagatcttctctgacccggcgatgtcgcaacaagctgcattgtcttatttgctacgtggacaagggctggagagtgatcagagtgacagtgcggcgatgacctcgatgctgattggcctgggggttgcgcaaagtggccagattgtgggtaaaatcggcgagacgtttggcgtaagcaatttagcgctcgacaccgagggagttggcgactcctcccaggtggtggtcagcggctatgtattgccaggtctgcaagtgaaatacggcgtgggtatatttgactctatagcaacactcacgttacgttatcgcctgatgcctaagctatatctggaagcagtgtctggtgtagaccaggcactggatttgctctatcagttcgagttttagcaatgcgaatatttgtctacggcagtttacgccacaaacaaggcaacagtcactggatgaccaatgcccagttactgggcgatttcagtatcgataactaccagttgtatagcctgggccactatccaggcgcagttccggggaacggaacagtacacggtgaagtttatcgtattgataacgccacgctggccgaacttgatgccttgcgcaccaggggcggtgaatacgcgcgccagttgattcagacgccgtacgggagtgcatggatgtacgtttatcaacgacccgtcgatggattaaagctaattgaaagcggcgactggttagacagggataagtaataataaaagcacgccaccttcgggtggcgttgttttatgcgatgtatctcgcgattttttttgtaactttcccatcttttgcttttctctccgggccgctttccatatctgcaatcgcataaaaaactctgctggcgttaacaaatgtacaggggtaaaacggggacacgctttgaacggtgagtatgagtgaggccggctaacttccagcaagtggctatgaacagcaaaatggtggtcgagtttagcttgttcttaccgttcaagcctttcaactgctgaaaataataatagtggagtagagagtttataaattgcgggcataaaaaaacccttactaaccgaagcccggtgttcagggttattgcgccagaagaacttatttattcttggcgcgctcgaaggaagcaacgatttcagctttagcggcttctgcgttttcccaaccttcaactttaacccacttgcctttttcgaggtctttgtagtgctcgaagaagtgagcgatttgcgctttcagcagctctggcagatcgttaacgtctttaatgtgatcgtattctttgctcagcttggtgtgcggaacagcaatcagtttcgcatcttcaccggcttcgtcggtcattttcagtacgccaaccggacggcagcggatcacagaacccggctgcagcgggtacggagtcgggaccagtacgtcaaccgggtcaccgtccagagacagagtgtggttgatgtaaccgtagttgcacggatagaacatcgcggtggacatgaagcggtcaacgaacagtgcgccgctctctttgtcgatttcgtatttgatcggatctgcgttagccgggatctcaataacaacgtagatgtcttccggcagatctttacccgcagggacgttgagtaagctcatgtctgtttcctttaaaaatatgtggcaaacaagtgccgagtattatagccaactcgcgccgaatgtcttcgcttgttttcgtcttcattttcctttttcgccagttttaagacggtatacagagcaggaaaatccataaccgtagccgcatttttcatagtgagatgaaagcgattacaaacttgtgattaacgttttatttacttttttgaagtgtgatgtaacgcaatccgttacataacgaattgtctatagttttttcgcgaacatcttttcaccaataataattaccccgacgaggacaaccctatgtggaaacgcttacttgtagtctctgcagtctcggcagccatgtcgtctatggcgttggccgctccattaacagtaggattttcgcaggtcggatcggaatccggctggcgcgccgcagaaaccaatgtggcgaaaagtgaagccgaaaaacgcggtatcacactgaaaattgccgatggtcagcaaaagcaggaaaaccagattaaagcggtacgttccttcgtcgcacaaggggtggatgcgatctttatcgctccggtggtggcgacgggttgggaaccggtattaaaagaggcgaaagatgccgaaatcccggtcttcttgcttgaccgttccatcgatgtgaaagacaaatctctctatatgaccaccgttactgccgacaacatcctcgaaggcaagttgattggtgactggctggtaaaagaggtcaatggcaaaccgtgtaacgtggttgagttgcagggcaccgttggggccagcgtcgccattgaccgtaagaaagcctttgccgaagccattaagaatgcgccaaatatcaaaattatccgctcgcagtcaggtgacttcacccgcagcaaaggcaaagaagtgatggagagctttatcaaagcggaaaacaacggcaaaaacatctgcatggtttacgcccataacgatgacatggtgattggtgcaattcaggcaattaaagaagcgggcctgaaaccgggcaaagatatcctgacaggctctatcgacggcgtgccggacatctacaaagcgatgattgatggcgaagcgaacgccagcgttgaactgacgccgaacatggcaggtcctgctttcgatgcgctggagaaatacaaaaaagacggcaccatgcctgaaaagctgacgttaaccaaatccaccctttatctgcctgataccgcaaaagaagagttagagaagaagaaaaatatggggtattgagggttgctatgcctgatgccgattcgtaggccggataaggcgctcgcgccgcatccggcggttgtgcgctgaagcctgatgcgacgcttaccgcgtcttatcatgcctactgggagcacgctttacaccgggggaaaccatgacgaccgaccaacaccaggaaatcctccgcaccgaaggattaagtaaatttttccccggtgtcaaagcgttagacaacgttgatttcagcctgcgccgtggcgaaatcatggcgctgctcggtgaaaacggggcgggaaaatcgacgctaatcaaagcattaaccggtgtataccacgtcgatcgcggcactatctggctggaaggccaggctatctcaccgaaaaacaccgcccacgcacaacaactcggcatcggcaccgtctatcaggaagtcaacctgctacccaatatgtcggtcgctgataatctattcataggtcgcgaacccaaacgtttcggccttctacgccgtaaagagatggaaaagcgcgccaccgaactgatggcatcttacggtttctccctcgacgtgcgcgaaccgctcaaccgcttttcagtcgcgatgcagcaaatcgtcgccatttgccgggctatcgatctctccgccaaagtgctgatcctcgatgaacccaccgccagtctcgacactcaggaagtagagttactgtttggcctgatgcgtcagcttcgcgatcgcggcgtcagcctgatcttcgtcactcattttctcgatcaggtttatcaggttagcgatcggatcaccgtcttacgtaacggcagttttgtgggctgtcgggaaacccgcgagctaccgcagatcgaactggtaaaaatgatgccggggcgtgaactggacacccacgcgcttcagcgtgccgggagaacattgctgagcgacaaacctgttgccgcgttcaaaaattacggcaaaaaaggaacgatcgcgccgtttgatctcgaagtacgccccggcgagatcgtcggtctggcaggcttgctgggatcaggacgtaccgaaaccgccgaagtgatcttcggtatcaaacctgctgatagcggcacggcgttgatcaaaggcaaactgcaaacgctacgctcgccacatcaggcttcggttcttggcattggcttctgcccggaagacaggaaaaccgatggcatcatcgctgccgcctcggtgcgggaaaatatcatccttgctctccaggcccagcgcggctggttacgacctatttcccgcaaagagcagcaagagattgccgaacgctttatccgccagcttggcattcgcacaccttccaccgaacaaccgattgaatttctctccggcggcaatcagcaaaaagtgttgctttcacgttggctactgacccgaccgcaatttctgattctcgacgagccaacgcgcggaattgatgttggtgcccacgccgagatcatccgcctgattgaaacgctgtgcgccgatgggctggcgctgctggtgatctcctccgagctggaagagctggtgggctatgccgaccgggtgattatcatgcgcgatcgcaaacaggtagcggagatcccgctggcagagctttccgttccggcgatcatgaacgccattgcggcgtaaggagaatagtgtgatgcctcaatctctcccggacactacgccgccgaaaaggcgttttcgctggccaacaggaatgccgcagctggcggcactgttgctggtgctgctggttgatagcctggtggccccgcatttctggcaggtggtgcttcaggatgggcgtttgttcggtagccctatcgacattcttaaccgtgcggcccccgttgcgctactggcgattggcatgacgctggttatcgccactggtgggattgatctctccgtaggggcggtgatggctatcgccggagccacaacggctgcgatgacggtcgcgggattcagcctgccaattgttttgttaagcgccctgggcactggcatcctggcaggattgtggaacggcatactggtagcgatcctcaaaattcagccgtttgtcgccaccctgatcctgatggtcgccgggcgcggcgtggcgcaactgatcacctccggacagatcgtcacatttaactcaccggatctctcctggttcggcagtggatcgctgttgttcctgccaacgccagtcattattgcggtgctgacgcttctcctgttctggctgttgacccgcaaaacggcactggggatgtttatcgaagccgttggtatcaacattcgggcggcaaaaaatgccggggtaaacacgcggatcatcgtcatgctcacctacgtgttgagcgggctatgtgcggcgattgcgggcattattgtggcggcggatattcgcggtgccgatgccaacaatgccggattatggctggagctggacgccattcttgcagtggtgattggcggcggatcgctgatgggcgggcgctttaacctgctgctttcggtggtgggggcgctgattattcagggaatgaacaccggaattttgctttctggctttccgccggagatgaaccaggtggtgaaagcggtggtggtgctttgcgtgctgattgtccagtcgcaacgctttatcagtctgattaaaggggtacgtaaccgtgataaaacgtaatttgccactgatgatcaccatcggcgtctttgtgttgggttatatctactgtctgacccagtttcccggttttgcttccacaagagtgatctgcaatatcctgaccgataatgcctttcttgggataatcgccgttggcatgacctttgtgatcctctccggtgggatcgatctctccgtcggttcggtgatcgcctttaccggcgtgtttctggcaaaagtgattggcgatttcggcctctcgccgctgctggcgtttccgctggtgttggtgatgggctgtgccttcggcgcatttatggggcttctgattgatgccctgaagatcccggcgtttatcattacccttgcgggaatgttctttttgcgtggcgtcagctatctcgtttcggaagagtcgatcccgataaaccatcctgtttatgacacgctctcaagccttgcgtggaaaatccctggcggtggtcgcttaagtgcgatgggactactgatgctggcggtggtggttatcggcatattactcgcgcatcgtacccgttttggtaatcaggtatacgccattggcggcaacgcaacgtcggcaaacctgatggggatttccactcgcagcaccactattcgcatttatatgctctccaccggactggcaacgctggcggggattgtcttctcgatttatacccaggccggatatgcactggcgggcgtaggtgtggaactggatgctatcgcctcagtggtaattggcggtacgcttttgagtggtggcgttggaacggtattagggacgctttttggcgtggcgattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagcgataaaaacgcctctccgtgtggagaggcgcaggagcttacgcgtccgggaactcacggataaagcgttcgacatcttcaaccatatggtcgttgccgacaaagaacgaacggcgctggtgcagggtttccgggataatatccagaatacgctctttgccatcgctcgctttaccgcccgcttgttccgccaggaatgccatcgggttgcactcatacagtaaacgtagtttaccgtccgggtggctggcggtgcttgggtagagataaataccgcctttcagcaggttacggtggaaatccgcgaccagtgaaccgatataacgtgaggtatacgggcggttggtggatttatcttcttcctggcagaatttaatgtacttcttcaccccgttcggaaacttaatgtagtttccttcgttgatggagtaggttttgcctttctccgggaagcgcatccgttcctggcacaggcagaaaacacccagcgaaggatcataagtaaaggcgtgaacaccgcatccggtggtgtaaaccagcatagtagaggagccgtataccacgtaacctgccgcaacctgtttgttaccaggctggaggaaatcttcttccgttaccggcgtgccaacaggcgtaacgcggcggtagatagagaaaatggtaccgacagagacgttaacatcgatgttggacgagccatccagtgggtccatcagcaccacgtattttgcgtgttcacagccttcaaagacgacaatctcatcttcttcttcagaggcaatgcccgcaacgatatcgcgtgctttcagtgcggctttcagtttctcattagcgaacaggtcgagtttctgctgaacctcgccctgcacgttctcagcaccgctggcacccaggatatcaaccagtcctgctttgttgatatcgcgatggataatcttggcgcccagttttattgccgacagcaaagcagtgagctcaccggtagcatgagaaaactcgtgctgcttttcgacaataaattcacctaacgttttcataaaactttccctgcaatgtttatggagtaaagcgaccgcaacaatcttaacaaataatcccaatgttgcgctcaggtgaatcgcgccagcaaattacggattatcctgaaatgcgtttctcacttgcccgacatatgcgtaaaatgagcgccagattaaaaaaggatagtgacgtatgcgcattcatattttaggaatttgtggcacgtttatgggcggtctggcgatgctggcgcgccagttaggccatgaagtaacgggttcggacgccaatgtgtatccgccgatgagcaccttacttgagaagcaaggcattgaactgattcagggttacgatgccagccagctcgatccacagccggatctggtgattattggtaacgccatgacccgtggaaatccgtgtgtggaagcggtactggaaaaaaacatcccttatatgtcaggtccgcagtggctgcacgattttgtgctgcgcgaccgctgggtgctggccgttgccggtacacacggcaaaaccaccacggcgggaatggcgacctggattctggaacagtgtggttacaaaccgggatttgtgatcggtggtgtgccggggaactttgaggtttcggcgcgtctgggcgaaagcgacttctttgttatcgaagcggatgagtacgactgcgccttcttcgacaaacgctctaaatttgtccattactgcccgcgtacgctgatcctcaacaaccttgagttcgatcacgccgatatctttgacgacctgaaagcgatccagaaacagttccaccatctggtgcgtatcgttccggggcaggggcgtattatctggccggaaaacgacatcaacctgaaacaaaccatggcgatgggctgctggagcgagcaggagctggtgggcgagcaggggcactggcaggcgaaaaagctgaccaccgatgcttccgaatgggaagtcttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaacgctcgtcgccgtctggagttgcgtggtgaagcgaatggcgtcacggtatatgacgattttgcccatcacccgacggcgattctggcaacgcttgcggcgctgcgtggcaaagttggtggtacggcgcgcattattgccgtgctggaacctcgctcgaataccatgaaaatggggatctgcaaagacgatctggcaccttcattaggtcgtgccgatgaagtcttcctgctgcaaccggcacatattccgtggcaggtggcagaagtggcagaagcctgcgttcagcctgcacactggagcggcgatgtggatacgctggcagatatggtggtgaaaaccgctcagcctggcgaccatattctggtgatgagcaacggcggttttggtggtattcatcagaaactgctggatggtctggcgaagaaagcggaagctgcgcagtaattcacagcctcagcctgatagagtgtgtgtaggccggataaggcgttcacgccgcatccggcatttgagcatagtgcctgatgcgacgcttgatgcgtcttatcaggcctacaggtgcaccgcatccggcaaaccatactcacatcaacaacgaaaattacccttcgttttccgctaactcacgcagatactggaaaatctggcgcgcggatttcggcggcttattcccttctttctctttcttcgcgttacggatcagagtacgcagttgctgacgatcggcatcgggccacagattcaatacttcagcgatggcgtcatcaccctggtcgatcagacgatcgcgcaggttttccagtttatggaacaacaccacttgctggttgtggcggtttttcagcttatccagcgcctgacggatcggttctacgtcgcgctggcgcagcatcttaccgatgagctgcaactggcggcggcgaccttccatcttaatacgctgggcgagctcaatagccgcgcgcagatccgcatctaacgggatcttatccagcgcgtttttccccagatcaacaatttccgcgccaaggcgttttagctcctcggcatcacgtttaatttcacttttactgacccagataatttcatcgtcttcgtcttcgatgtcatcaccgggaacgtcgtcgagccagtcttcgggctgcttagtcatctcaggctccttaaaaaaagaggctaatgttaccagttaagatgcgcactgaaaaacggttctctgttagacttcagagaaactctctacattatggcacttgcaatgaaagtaatctctcaagttgaagcgcagcgcaagattctggaagaagcagtttcgactgcgctggagttggcctcaggcaaatcggacggtgcggaagttgccgtcagcaagaccaccggcattagcgtaagcacgcgttatggtgaagtggagaatgttgaattcaatagcgatggcgcgctggggatcaccgtttatcaccagaaccgtaaaggtagcgcatcgtctaccgatttaagcccgcaggccattgcccgcaccgtacaggcggcgctggatattgcccgttacacttcgccagatccgtatgcaggcgtggcagacaaagaactgctggcctttgacgcaccggatctcgacttgttccaccctgcggacgtttctccggatgaagccattgaactggcggcccgcgcggaacaggcggcattgcaggcggacaaacgcatcaccaataccgaaggcggtagctttaacagccactacggtgtcaaagtttttggcaacagccacggcatgttgcagggttactgctcaacgcgtcattcgctctccagttgtgtaatcgccgaagaaaatggcgatatggagcgcgattatgcctacaccattgggcgtgcgatgagcgatctgcaaacgccagagtgggttggggccgactgtgcgcgccgtactttatcgcgcctgtcaccgcgtaaactttctaccatgaaagcgccggtgatttttgccaatgaagtggcaacagggttgtttggtcatttggtgggggcgatagcgggtggtgcggtctaccgtaaatcgaccttcttgctcgactcgctcggtacacaaattctgccggactggctgacaattgaagaacatccgcatctgctgaaagggctggcatctacaccattcgacagcgaaggtgtgcgcaccgagcgccgcgatatcgtcaaagatggcatcctgactcagtggctgctgaccagctattcggcgcggaaactggggctgaaaagcaccggacatgcgggcggtattcacaactggcggattgccggacaagggctaagcttcgaacaaatgctcaaagagatgggcaccgggctggtggtgacggagctgatgggccagggcgtgagtgccattaccggtgattattcccgtggtgcagcgggcttctgggtagagaacggcgaaattcagtatccggtgagcgaaatcaccatcgctggtaatttaaaagatatgtggcgcaatattgtcaccgtcggtaacgatattgaaacacgcagtaatatacagtgtggttctgtgctgttgccggagatgaaaatcgccgggcagtaaaaaaactggcgcgtcctgccgcgctataaactaaaaaattacacaaaatcattcgcactgcatcgagacggaaagtgaatgagagcaggggagcgtactcgtagtacgtgactcgggcgaatgagcgtagccgtcgatgaggcagtgtgaaggatgaagtgtaaataaaaaaggaagtgagcaatgcgtaaaagcctgttagctattcttgcagtctcctcattggtattcagttcggcgtcgtttgccgctgatctggaagacaatatggaaaccctcaacgacaatttaaaagtggttgaaaaagccgataacgcggcgcaagtcaaagacgcgttaacgaagatgcgcgctgcggcgctggatgcgcaaaaagcgacgccgccgaagcttgaaggcaaatcaccggacagcccggaaatgaaagacttccgccacggtttcgatattctggtcggtcagattgacgacgcgctgaagctggctaatgaaggtaaagtaaaagaagcgcaggccgccgcagagcaactgaaaacgacccgcaacgcctatcaccagaagtatcgttaattctttatttccctgttgcctgcactcaggtaacagggaacttatcatcgcaaatgatgcaccacctgattgctgctgccgcgccagatcagggaagggtcttttaaatcctgcacaaatttgccgtcgaccagcacgttaatcaaatcaacaacctgcatttgcgcagcgttgagttcgtcgagtttatagcctgtccacacccagatgtctttacccggacactcggcgcggatgcgttgtaccagtttcagaatatccggcacgttttgcggatgtagcggatcgccgccggagagggaaataccctggcgtttgatacgagtgtcattcagatcgttaatgatctggtcttccattgctttggtaaatggctgaccggaatttacccgccaggtgcttttgttatagcaaccggggcattcatgaacacacccggagacaaacagggtgcagcgagtgccggggccgttgacgatgtcgacaggatagtactgatgatagttcattatttcacctggcttatcagtccgcgtgtaggctgcatccggtaatcaacgcctgatgcgacgctgtcgcgtcttatcaggcctacagccgttgccaaatgtaggccggataaggcgtttacgccgcatccggcatttgcttaacacagagtgaagattaacctatctgcccatttcccaaatgtttaacgcggcgcttaacttcttcctgcttaccagcgttaaacggacgtgcatccgggctacctaaatatccgcacacgcggcgagtcaccgacacacgggaggtgtcatggttaccacatttcggacaagtgaagcctttgctggtgcactcaaattcgccggtaaagccacactcgtagcattcatcgatcggtgtgttggtgccgtaatacggtacatgctgatagctgtaatcccagacatcttccagcgccttcaggttgtgctgaatgtttggatactcgccatagcaaatgaagccaccgttcgccagtggcgggtaaggcgcttcaaagtcgatcttgtcgtacgggttcaccttcttctccacatcgaggtggaaactgttggtgtagtaacctttatcggtcacgcccggcaccacgccaaactcagcggtatcgagacggcagaagcggtcacacaggttctcactcggcgtactgtagaggctgaaaccgtagccagtttcttctttccactgatccaccgcctgacgcagacgctcaacaatcgcaatacctttcgcgcgcagctgctcgttgtcgtaaacatgctcgccgccgaacagcgcgttaatggtttcgtggatgccgatgtaacccagcgaaatagacgcacgaccgtttttgaagatttcagaaacgtcgtcgtcagcattcagacgcacgccacaagcgccttccatatagaggatcggggctacgcgcgctttcacgccttcgagacgagcgatacgggtcatcagcgccttacgtgccaacaccagacgttcatccagcagcttccagaaggtggcttcatcgccttttgcttccagagcaatacgcggcaggttcaggctgatcacgccgaggttgttacgaccatcgtggatctgctcgccgttttcattttcccacacgccgaggaagctgcggcagcccatcggggttttaaacgaaccggtgactttcactacctgatcgtagttcaggatatccggatacatgcgcttgcttgcgcactccagcgccagctgtttgatgtcgtagttcggatcgccttttttatggttcaggccatcgcgaatcgcaaacaccagtttcgggaacaccgccgttttacggtttttaccgaggcctgcgatacggttacgcaggatcgattcctgaatcaggcgcgattcccagctggtgcccagaccaaaaccaaaggttacaaacggcgtttgaccgttggcggtatgcagggtgtttacttcgtactccagcgactggaaggcatcgtagcactctttgatggtacgagagttagcgtagccttcggcgtccgggatgttccactcttctgcggtcttgcgatgtttgttgtagctggcggtgacaaacggtgccagcacttcatcgatacggttaatggtggtgccgccataaatatggctggcgacctgagcaataatctgcgcagttaccgcggttgccgtagagatcgacttcggcggttcaatctcggcgttccccattttaaagccctgggtcagcatgcctttcaggtcgatcaacatgcagttgaacatcgggaagaacggcgagtaatcgagatcgtgatagtgaatatcgccacgctcatgtgcctgcaccacgtcacgcggcagcaggtgctggcgtgcatagtgtttagccacgatcccggccagcaggtcgcgctgggttggaatcaccttgctgtctttgttggcgttttcgttgagtaacgaggagttggtctgctcgaccagaccacggatctcctggttcaggcgaccgcgtttttcacgttcaatgtcgcgatcgtgacggtactcgatgtaggcacgagccagttgtttgtatggccccgacatcagctggttttcaactgcggtctggatctcattgatatccacttggttgcggccctgcatctgctcgctgacaaccgcagcaacagtggcgcaataatcggcatcatcgacttccgctgctttagctgcacgcagaatcgcttctttgatgcgctctgatttaaacggcactttgcagccgtctcgtttcatcacatgcggtgtcatgatcgctccatatttttaagaacaggttatccacagaaattgggaaaggcgttttccggttttttcgtttcgttttccggtgctttccgcaatcgccatccgcttatccacaacgccgcacctttttcgtggggagctgtagtagcaattatagtcgattaatacaacatattgggttgggacgcattttaaagtctatatatagtgctttgcatcaaggatgtttgaactttttttgatgtagctcaaagtaaaaagcagagcgtacggatgacgggcgctacagcgatatgtaaattttttaatgaattttttgattataaaatcaacaaaaacaacatgctgacaggcaaaaccccggaatgacaggcattaccggggcttagcgaagatttacttctgtaaccaccagacagcctcaaaaggccgtaaagtcatggcacagggttgtggtgaggcttcttcgtagttatgcatcacaagctgccagttgccgagcattttccctggctgccagggttgggtctcacggctaaggttggcaatgaccagcaaggtttgccccttccactcacggcgatagcaccacaatacagggctgtttggcagcagatcctggtaatcgccccatgtcaggacggcttcttgcttacgcagtgcgattaacttttggtaggtgtaaaacaccgaggactcatcggccagcgctgcttctacgttgatttcctgatagttatcgcccaggccaatccacggttcgccagccgtaaacccggcattatcgccgttggtccattgcatgggggtgcgactgttgtcacgggatttactggcgaggattgccaataactcgtcggcatcacgcccatcgttgcgcagctcggcaaacatattgaggctctccacgtcgcgatagtcagtaatgcgcgtgaaatgtgggttggtcatgccaatctcttcgccctggtagatatacggcgttccctgcatgccatgcagcaccatcgccagcatttttgccgcaggcacacggtattcaccttcatcaccaaagcgagaaacaatgcgcggctgatcgtggttacaccagaacaaggcattccatgccacgttgtgcattccttgttgccagtggcggaacaatgttttcaacgccacaaagtcaggtttagccagcgtccatttttcaccaccgggataatcgaccttcaggtgatgaaaattaaaggtcatcgacaattcactgcctgtcagtgccgcgtatcgctggcaatgctcaaggctggtggaggacatttcacctacggtcattaacccgcgtggcgtaaacacatcgcggttcatctcgtgcaaaaattcgtgtgctcgtggcccgtcggtgtagaagcgacgcccgtcgccatccaggtcttcagggtaacgcgggtctttggagatcagattcaccacatccaggcgcaacccgtcgaccccacgattggcccagaactcacagacttttttcagctctgcgcgtaccgctggattctcccagttgagatccgcctgttctggtgcaaagagatgcaaatagtactgttcgctttccgcatgccagcgccacgcactaccaccgaattttgaacgccagttgttcggtggcgtttctggttctccatcgcgccagatataaaactggcggtaagggctttctttgttcagcgcctcgcgaaaccaggcatgttgggtagaggtatggttaaacaccatatcgagaatgatacgaatcccacgcgattttgcctgtgtcaccagttcgtcaaaatcgtccagcgtgccataggtgggatcaatcgccgtataattcgctacgtcgtaaccgttatcgacctggggagagacataaaagggggttagccagatggcatcaacgcccagtttatgcagatagtccagacgctggataacgccacgtaaatcgccggtgccgctacccgtggtgtcctgaaaactctttggataaatctggtagataacgccgttttgccaccagtggggaagatgagtcattacgttattcctgcaaatgcgagggggcgcaattgcgccccgaagaaaattaaacaatgtccagcgtgcccaggcggtatttccgctgatagataaacgaggtgagtacaatcgggatgatgatggcgatagccattgccagcgcaaacacctgccagtagctcggttgaatcgagagaattcccggcaggccgcctacgccgatgccattcgccataacgccgttcaggccgcatagcaatcctgccagaccagaaccaatcatcgcgcacagcatcgggaagcgatatttcaggttgatgccgtacattgcaggctcagtgaccccaagccaggcggagatcgccgcaggcacggagatctcgcgttcattgtgcttgcggctggaaatgataatacctatcacagcggagccctgagcgatattcgacagcgcaatcagcggccacactggcgtgccacccatgctttgaatcatctgcaaatcaatagcaagcgtggtctggtgtacgccggtgatcaccagcggggcgtacaggaagccaaacaatgccgcgccaatcggagcaaagctgccggtcatcaggtgacgtaccgcaaaggcaacgccatcgccaatcatgcgaccaaacggaccaatcagcgcatgggcgaggaacaccgcgaggatcagcgaacagacgggcaccaccaccaggtagaggtaatccggcacgatgcgcttaagacgagtttcaataacgcccagcgccagcccggctaacagtgccggaataacctgtgcctgatagcccactttggcgatgctgaacatgccaaagttccatacttccggcagctgctgcccgagcagataagcgttcatcaactgtggggaaaccagcgtcacgccaagcacgataccgaggatcggtgtaccgcccatttttttcaccgctgaccagcaaatcccgaccggcaggtagaagaagatcgcttcaccgatcaaccacagaaaatcgtagatcgtttgcagggaagggtacatttgcgccagcgtttgaccgttgctcatgggcaaatcgccgatcacattgcgaaaaccgaggatcaaaccgccgctaatcaacgcgggcagcaacgggaagaaaatctccgcgaaatgagagatcaactgctcatgccatttcatattctgccgggcggctttttttacctgctctttatcaacctgcgcctgtccggttgacgctatcagtgcttgatagtaatcacccacgttggtgccaatcaccacctgaaattgcccggcattggtgaaacagcctttcaccatggggagttgctcaatttctttcggtctggcattggccggttggttgaggacaaagcgcagacgagtaatacagtggctcaccgtcgcaatattgccgcgcccgccgaccagttcaatcaaccgatcgatatccgtttggtttattttgctcatcataaagccccatggcagatgacatttttggttggctgcagaatatattgcgcggaaaaatttaaaaacgggaacgttcccgaaacgcagcgaagatcacaatttatcgttcaggaaacgatcaggacagggtggcggggatgatgatttgttgcggttcgctgcgcccggtgacctgcgcgatcaactggcaggccgcctggcgtccagcttcggcgtaaccgggatctacggtgacgatctccggatggaggaatttcattaacggtgtattaccgacgctcgccagttgcaaggtgtcgatgcgttgctcttgcaggtatttacttgcgccaagtgccagcgtgtcggttgcgcacagtaacgcggtagtttcaggcgtaatcacttttgctacgttctcatagccttgcttcatagcaagccctggcagagcggcaacgggatgcaatttatgcgctttgcagaacgccaggtaggcttcgtgacgtcgcttaccggtcgtcacgtcactatgcggcacgccgagataactgatattacgatgcccctggtcatacagccgttgcatcaggatcttgattgccccttcgtcgtcataacagaccgaagcaaagccttttgcgtcacgcgccagcagaaccagcgatgactgccagtgggctaacatttcttctgttatgccggtaaaaccgaacagcactacgccgtcgatattacgccgtttcaggacccccaaatgttcggcaactaattgtggggaaaactgactttccatcatgattggatcgtaaccttgttcatagaacgctggcagcatggtttgaacggcgagattttctgacaacgaatccagacgggtaacaatgatggcgaccactttatcgctttgcccacgcatagcgcgcgcagagcgggaaggggaaaatccatgctgattcatcactgcttcaacacgctcgcgcgtgcgctggctcacgccgctttcgttattcagcacccgggaaaccgtagatttccccacgccgcttaagcgcgcgatgtctttgatggtcagccgattttgcatcctgttgtcccataacgtgttgtttaattatttgagcctaactttacctgtgcattcagcaatgggtaaagtctggtttatcgttggtttagttgccagcaggtattatatcgccataaatgctacgaatattattggattctccttattatttgcggcgcttttttcacttaccggaggttatatggaacctgatcccacgcctctccctcgacggagattaaaacttttccggtaagcccgtcttttcacggcgttaccggatgcgtaaggccgtgacgttttaacgtccctgctcagctttattaccttcaggtaaggcttcgccacgcctgaagacatttctgtactgtttcagacagtgcggagggactccttatgtttaaagaaatttttacccggctcattcgccatttaccttcccgtctggttcatcgtgatccattgcctggcgcgcagcagacagtgaatgcggcggtcccgccttctttaagtgcgcattgcctgaaaatggcggtgatgcccgaagaagaattgtggaaaacgttcgacacccatccggaagggttaaatctggcggaagtggaatctgcccgcgaacaacatggtgaaaataaattacccgcacaacaaccgtcgccgtggtgggtacatttatgggtctgctatcgcaacccctttaatattttgctcaccattcttggtgctatttcttacgccacggaagatttatttgccgcaggtgttatcgcgctaatggtcgctatttctacgttgctgaactttattcaggaagctcgttccaccaaagcggcagatgccctgaaagcgatggtcagtaataccgcgacggtactgcgagtaattaacgacaaaggcgaaaatggctggctggagatcccgatcgaccagctggtgcccggcgatattataaaactggcggcaggggatatgatcccggcagatttacgtatcttgcaggcgcgggatctgttcgtcgctcaggcgtcgttaaccggtgagtctctgcccgtggaaaaagccgctactactcgccagccggagcacagcaatccgctggagtgcgacaccctgtgttttatgggcaccaccgtggtgagcggcacggcacaagcaatggtgattgctacaggagccaacacctggtttggtcaactggcggggcgtgttagtgagcaggaaagcgagccgaatgcctttcagcaagggatcagccgcgtcagtatgctgctgattcgctttatgctggtgatggctccggtggtgttgcttatcaacggttacaccaaaggcgactggtgggaagcggcactgttcgcactttcggtcgcggtaggcttaacgccagaaatgttgccgatgattgttacctcgacgctggcgcgtggcgcagtcaagttgtcgaaacagaaagtgatcgtcaaacatctggatgccattcagaactttggcgcaatggatattctgtgcactgataaaaccggcaccctgacacaggataaaattgtgctggagaatcataccgatatctccggtaaaactagcgaacgcgtgctgcatagcgcgtggttgaacagccattaccagaccgggcttaaaaacctgcttgatacagcggtgctcgaaggtacggatgaagagtcagcgcgctcgctggccagccgttggcaaaaaattgatgagattccatttgatttcgagcgtcgtcggatgtcggtggttgtggcagaaaataccgaacaccatcagttggtttgcaaaggcgcattgcaggaaatcctcaatgtgtgttcgcaagtgcgtcacaatggcgagattgtaccgctcgatgacaccatgctgcgtaagattaagcgggttactgatacgctgaatcgtcaggggctgcgcgtggttgcggtggcgacgaaatacctgccagcgcgtgaaggagattaccagcgggcggatgaatccgacctgatcctcgaaggatatattgctttccttgatccgccaaaagagacaacagctccggcactgaaggcattaaaagcgagtggaattaccgtaaaaatccttactggcgacagtgagttggttgcagcgaaagtgtgccatgaagtggggctggacgcgggagaggtggtcattggtagtgatattgaaacgctatctgacgacgaactggcaaatctcgcacagcgcaccacgctgtttgctcgtctgacgccgatgcataaagaacgcatcgtaacgttgctgaagcgcgaagggcatgtggttggctttatgggcgatggtattaatgatgcgcccgccttgcgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagctctaacttcggtaatgtgttcagcgtgctggtggcgagtgctttcttgcccttcctgccgatgttgccgctacacttgcttattcaaaatctgctgtacgatgtgtcacaggtggcgatcccatttgataacgtcgacgacgagcaaattcaaaagccgcagcgttggaatccggcggatctggggcgctttatggtcttcttcggaccgatcagctcgattttcgatattctgacgttttgcctgatgtggtgggtattccatgccaacacgccggaaacgcaaacgctgttccagtcgggctggtttgtggtgggcttactgtcgcaaacgctgattgtgcatatgatccgcacccgtcgtgtaccgtttattcagagctgtgcatcgtggccgttaatgattatgaccgtgatcgtgatgattgtcgggatcgcattgccgttttcaccgctggccagttatctgcagctgcaggcgctgccgttaagctatttcccgtggctggttgcgattctggcagggtatatgacgttaacccagttggtgaaagggttctatagccgtcgttacggttggcagtaaagaataaactgggcatggtggcccggaatcagattgcagacaaagtgagctttgttcatgccggatgcggcgtaaatgccttatcaggcctacaaattcaataaattgcaggaatcacgtaggcctgataagcgtagcgcatcaggcaattttgcgtttgtcattagacttaatccgggcatgatagcccggatttccatcaagattagcgacgaacagcgatcgcttcgatctcaatcttcacgtctttcggcagacgagcaacttcaacgcaagaacgtgccgggaaggtggcgttgtgttcggtgaaaaaggcttcgtaggtagcattaacggttgcgaagtcgttcagatctttcacaaacacggtggttttaacgatatcgcccactttcaggccagcggcttcgacgatcgcttttacgttatccagcgactgacgtgcctgtgcagcgacatctgccgggacttcgcccgttttcgggtttaccgggatctgaccggaagtgataatcatattgcccagatcaacgccctgcacgtaaggaccgatagctgccggtgcattttccgtcgcgatagttttgctcatgatttctcctttattacagcggtaaaaagtctggctcattatagggagccagacttttattaccaaccgcaattaattggccagcaccacattatgggaaaactctttttcacagtatttgcatttgagcgcgatatcattggcgcgttttcgcacggcaaagctggatgaaaccggttcggcatggctgatacagttgctgttcgggcagaccagcacattgtcgatgcgctctggcagactggggcgcgatttgccaaccacttcatagttgtcgatacggttaaccgtggcttgcggtgcatataacgccagctgatcaacctgatcctcacttaaaaaggtattttcgattttgatcagatccttgcgccccatctcgccagaaggcaggttcagaccaatggtgatgcgctgatctgtttcggtcaacttgaacagactcaacagtttaaaaccgatctgggcggggatatggtcaattaccgtgccgcgtttaatagcttcaacctgcaatttattatcgtgtgtcatctctatttccccttacagtaccagatcgcgattcagaaccagtgccagtaacgcctggcgagcgaaaatcccgttgcctgcttgctggaagtaccaggcgtgaggcgttttatccacatccgtcgcaatctcatcaacacgcggcagcggatgcagcactttcatattggctttggcgttgtggagatcgctggcgcgaagaacaaactgcgctttcacgttggcgtactcggacgggtccagacgctctttttgcacgcgggtcatgtacaggatgtctacttccgccatcacttcttcaatagagctgtgcagactccaggcgatccctttttcatcgagcatatccagaatgtattgcggcattgccagcgcatccggcgcgataaagtaaaaacggttgccgtcgaacttcgctagcgcctgggtcagggagtgaacggtgcggccatatttcaggtcaccaaccattgcgacgtggagattgtccagacgcccctgggtttcctgaatggtgaataagtccagcaaggtttgcgtcggatgttggttggagccatcaccggcattcagtaccggtacattgccggaaaactcggtggccaggcgcgctgcaccttcctgcggatgacgcatcactatcgcatcgacgtaagtgctgataaccgaaatggtatcggccagcgtttcgccctttttacccagtgatgtattggcgctgtcggagaagcccaccacgctggcacccaggcggtgcatggaagtttcgaaagagaggcgggtgcgggtagaggcttcgaagaaacagctggcaataactttgtgcttcaacagctctggttgcgggttcgctttcagtttcgccgctgtcgccagcaccagattaaggtcatcgcgactaaggtcgtttatggaaatgatatgtttctgatatagcggattagccatcttttatctcctgacgcctgggcaaaaaaaagcccctcgattgaggggctgggaatgggtgatcaacgggaagaaaaacggcaggccagcgtcttttttcagacgcggtaagacaaaatgtcgaacacactgaaccatacatcctcccggcaaattgtccggcattatactcagctctgagagaggatcaagaagatgatgcagttataaagcaaggcaaacggttatcatgaatatatattcaattttaataagtaattaatttgcttgtgcaccagggctgtacgctttaccacacgtggtgcgacccaaacgatattgctgccagcaatcacgccaagaatttctggcaaagcatggaaatcaaggattcgtgctactgcccgaccatatccggcgacggtatggataaggataaattcaccattatgctcgacactcaggaccatttcagcgacggatcgacctgcgtcaggtgtgggaagtaattgaggattcaccgaataaattttttgtccttttgtatttctaatttttatgactcccagcaatttcagtagtcgtgaaacggttgactgactgatactgtcaaagccatggttttgcaaatcgcggcggatttcctcctgtgaaagataacttttttcggtaatcaggcgctgacagaccgccagttgcttcttttctttggcggagtaatcatcgtattccttcataatgcaccttttatttattattacctgatgatatttttcacattttataatgtgagagtggttcatttatcactacaccagatttgaaggccgctttgataagcggcctgtcgcgttaaatcatcgcggcgatactcagcacaatcatattcaacatcgtgagaatcagcagtagcggtgctacccatctcagataacggacccagggtacacgggcaatcgccagaccgcccatcactaccgcagaggttggcgtaatcaaattaaccaccccggaagcagactgataagcggtcaccaccagatcgcgttgtacatgagcaaaatcagcgagtggagccattattggcatcgttaacactgcaaggccggaagatgagggaaccagaaaagagagcaatacttccagccaataggtcacgttgatgaaaacagtggtggaaagccctgaaaccagattctcagcactgtgcagaattgtgtgcgtaatcatgccgttatccatcacgaccacaataccgcgggcgatgccgataatcagtgccacaccaaggagatcccgcgcgccgtcaataaaggtactggtgaaggtttcttcgcccatgcgggcaatgacacccacgatgaccgcagctgccagaaagacagcagagatttccgccatccaccaacccagtaccgctacgccgtaaatcataaaggcaaaggatgcagcaaaaagtatcaggatcgctttgcgcgtgggggtaaattccagcatcgtttctgaacgatttcccagaaaatgcgcctggttttcagccatcttatccgccacgatagagctttccggactgttgcgaactttgcgggcataacgcataacccagtaaacacaaatcacgtagcctactaacagcaaaataacacgcagcaaaatgccctgagtaaaggggatccctgcggcgttggcagcaatgacggtagcaaatgggttaatggttgagcccagcgtgccaatgcccgatcccaataacactgtggcggcagcgaccagaggatcaaagcgggcagccatcatgacgggcaccagcaacgtgtagaaggggagtgattcttccgccatcccataaatagtaccgccagcagcgaagagcgccatcaggatcggaatcatccactcttcccgaccattaaggcgagttgtcactcgttcgataccggcatctattgctccggttttatttactactcccaaaaatccaccgatgatcaggacaaacagcgcgacatcaatcgctcccgcagtgtaggtttgatggttgtacaagccgtcgatgggcgctaacaggacagccgtaataccctgtggttgcgcctcaacaggtgcgtaagtgcctgcaacaggaacttcctttcccagtgcggcatttgtcgccatctgatattttcccgcaggtacaatccaggtcattgccgcaactaacgcaatcagcacgaacaagatggtataagcggtgggaaatttgaatttacccataatgtgatctccataatcacgggcatacgccactcgtcgacgcatgcccgtcagggttagtcgccgagagttgctaccatcaccgctttaatggtgtgcatccggttttctgcttcatcgaaaacaatggagtgggcagattcaaaaacctcatcagttacttccagtcctttgaggccgtaggccatctcgatctcgcgtcctactgtggtgtgctcattatggaaggcgggcaggcagtgcataaatttgacttcagggttacgcgtggcagtaatcacctgttgattgatctgataaggtgtcataagactcactcgttctgcccaggcttcttttggctctcccatcgaaacccaaacatccgtatagagaaaatcaacgtcgtatacgccttcttccacatcctctgtcagggtgattctcgccccagtcacgctggcgatctcacggcattgtgttaccagcgcttcatctggccagaaagattttggtgccaccagacggatatccatccccatttttgcagcaccaaccatcagcgagttccccatgttatttcgggcatcaccaagatacgcaaagctcagctctggcagcgttttgcctggcgcatgttccagcatggtcattaaatccgcgaggatctgtgtcgggtgaaattcattggtcagtccgttccataccggaacaccagcgaactcacctaattcttcaacgatattctgaccataaccgcgatactcaataccgtcatacatgcgtccgagtacgcgagcggtatctttcattgattctttatggccgatttgtgagccgctggggccgatgtaagtcacctgcgcaccttgatcaaaggccgcgacttcaaaggcacagcgggtacgggtagaggatttttcaaaaatcaacgcaatgtttttaccgaccagcgtttgtttttcgtttccagatttcttggcggctttaagattgatagccaaatcaatcaggtattgaatctctgctggggtgtaatcaagcagcttaagaaaattacggtttttcagtgaagtagccatggggatgtccttataaaaatggatcaagcgtggttatgggggtatcaaggcgaataagagtgcctttgtctccggcgagaatttccggaccatctgcaagagagccgatccctgcaatgccccggcactgactaacaaactttgcgcaggcggtgactttcggccccatagacccggcatcaaactgcatttcgttgagtaattccggcgtgacctgggccagcgggcgttgggttggcttgccccagtcgagatatactgcgtccgcatcagtgaggatcaacaaggcgtcagcatggatctgacttgccagtagcgcggctgaaagatctttgtcgataaccgcttcaatcccatggtatccatcggctttttcaaccaccggaacaccaccgccaccattacagatcaccagatgatcgtgggcgatcagtgtctggatggcatcccgctcgacgatgcgtttaggttgtggagaaggtacgacccggcggaaagagtgaccatctgctttgaaaacccagcctttttctgcctgtagtacctgagtctgagcgtggtcataaattgggccgatgtacttagttgggttactgaaggcgggatcgttggcatccacttcaacctgcgtcagcagaacgctgatttcacgttgtggtagttgatttttcagcgcctgttgtagcatgtagccgatcatcccctggctttcggcccccagaatgtcgagtggatagggagcgacatgggcataggcgctattttgaagtgccagaagtccaacttgtggaccattcccgtgaaccagtacaacccgccagtgttgagtcagttgggcgatagttttagccgcaagatcgatatttttacgttggatttctgcttcgagtggttcgcctcgtttaagcagggcattaccgccgagagcgataaccagtgttggtttgttttccatgatctcttccttagataccgtcacgatgcaaagggcaactcatgcaacgtgcgccgccacgtccgcggcctaattcatcaccggggatgggtaaaacggtgatgcctgctttgtcatatttttcgttagtccagatgttgcgctcgtagcccactaccactcccggccgaagcgtgagcacattgttagcgtcattccactgttcgcgttctgcctcaaaggcatcaccccccgtggtgattaaacgtacctggtcaataccgagggctttttcgatagcatggaggagtgtgctttcttgagtacgtttcaggccgccgtgaccgtcaggtgttagcgtccagcaattaacatccgggcgcacaacttcgggataaaccgagaaggtgtcgatatcgatatgagtcataacggtgtcaagatgcatacaggagcggtgtttaggcagctcaacagcgattacccgttcagcctgacgatgtttaaacaatgcctgagcaagaaactcgattccttgtggcgtggtgcgttcagacatgccgatcaacacggccccccgaccaatcaccagcacatcaccaccttctaacgtggcgtggtcataattaatattctcgtcgccgaaatatttaataaattcgccgccagcaaattgtggatgccagcgataaatagcgcgtagattattggtttcacgttggcgagcaggttttgccattggattaatcgatacaccgttataaatccagcatgaggtatcacgcgtaaataaatgattcggtaacggcttcataatgaaatcattaatatcgtgggtatcaaccaccatatttttaattgaggcgggaatttcactataagtcagcccaccacttaaatgacgagcaaggtcccggtgtgacatctctgcaagccaggtgcgaacgtcagtagcaaacgtagggccgagtcggtaatctgatatttgtgtttccagtaaccagcttttggcttccgggatatccaatgtttgtgttagtaaatcagtgagtaacagaacttctatcccttgctggcgcagcgtattggcgaaaatatcatgctcttcacctgcccgctcaacggacaatacatcgtcaaataacaactcctggcaattggatggtgttagacgtttcagactgagatttgggcgatgcaacataacgctgcgtagttgtccaatttcagaaccaacataatgcttttccatcattattcctttaacactttttcaaaaataaagaggagatggctgcaaacaaattaaatgcttgtagtcaggtctgttcagtaattttcagatgcaatgattcagtttatttcttccagaaaatgtgacgactttcacaccagtgatgatattaataatcgcagttaataatatttgatgcggttctgataaatgataaagaaacaaaatacgataatgcattaatacgcaaatatacgcagagttattcttcgttgttaattgattgttttatttttcaggaaatgcctttaagtataaagcattgatatttatgtatattttaatattcattgcatatctatgcgaaagaataaggtgattatttttcacagcactattttcacgggataactatgacagcacgggcattaaaagctaagaaaatgaactgtgatctgactgagagttttcttttaacatatgcaataacaagatattaggaccaaaatacatagctaagttataagatttatgcagcaaaactgcatacaaaattactcctgcttaacatcagtacaacatctccagcaataaacatgcgcaagggcaaaacctgatgatttttctatggtgagaggtggctttttttcgtataaggaaagaagtgaaacattgttttaataaaggaagatattatgattgttggcaacatccatcacttacaatcctggctgccggaagaacttcgcgaagcaattgagtacatcaaatcacatgtcagcgatgagacagcaaaaggtaagcacgctattgacggcgaccgcctgttttatctgatttctgaggatacgactgaaccaggtgaactgcgtcgtgctgagtatcatgctcgttatctcgatatccagattgtattaaaagggcaggaagggatgacatttagcacgcaaccagcaggcgtaccagagactgactggctggcagataaagatattgcttttatcgggcaggggatcgatgaaaaaacagtgattcttaatgaaggggattttgtcgttttctatcctggcgaagttcacaaaccgctttgtgcggtgggagcccccgctcaggtacggaaagcagtagttaagctattaaaatcgtaagtgatcactgccggggggcgacctgtgccgccgcccggcaaaacgttattttgctaatgtagcgaccataacagcttttatggtgtgcatccggttttctgcctggtcaaagacaatacttgccggagattcaaagacttcatcggtgacttccattccaccatacagaccgaattctgcggccatttttttacccagcgtggtttgctcatcatgaaatgcaggcagacagtggaggaacttaacctgcgaattaccggtcagggccatcattttgctattcacctgatagtcacgcagcagggcaatacgctccgcccatttctctttgggctcacccatcgatacccagacatcggtatagataaagtctgcacctttaaccccagaggcgatatcttccgtcaaggtgattttacccccgtgtttttgtgccagagcactgcattcggcgaccagcgcagcttccggccagcatgcctgtggcgcgaccagacgcaaatccagaccggtaagcgccgcagcttcgagcatcgaattgcccatgttgttacgcgcgtcacctgcatagaccagcgtcatttcgttgaatgctttgccgggcaaatgctcctgcatggtgaggagatccgccagcagctgcgtggggtggaactcattggtcaggccgttccatactggcacgccagcgtattccgccagtgtttcgacaatctcctgaccatagccgcgatactgaataccgtcatacatgcgaccaagcacgcgggcagtgtctttaatcgactctttgtgaccaatctggctgccgcttgggccgagataagtaacgcgagcaccctggtcatatgcggcaacttcgaaagagcatcgggtacgggtcgagtctttttcgaagatgagcgcgatgtttttgccagtgagtctggcttcttctttaccgcttttcttatcggctttcagcttcgcggctaactgcaacaagctgttgagttcagctggcgtgaaatcgagtaatttcaggaaatgcttatgataaaacccggacatagatccctcctgtggtcaacgccttaatgaattaaaattcaatctatatggatgattattcatttgcaagtctaaagcataaatctttgtcacaaaggtggaggcaatgtcagtggtgtgtgacaataagagtatcggcaggacattaagaggaatgagccatggcaaacccggaacaactggaagaacagcgtgaagaaacacgtttgattattgaagaattactggaagatggcagcgatccggacgcgctgtacaccatcgaacaccatctttccgcagacgatctggaaaccctggaaaaagcagcagttgaagcgtttaaactcggttacgaagtgaccgatccagaagagctggaagttgaagatggtgacatcgtgatttgctgcgacatcctcagcgagtgtgcgttgaatgccgacctgatcgatgcccaggttgaacaactgatgacgctggcggagaaatttgacgttgagtacgatggttggggcacttactttgaagatcctaacggcgaagacggcgacgatgaagattttgtcgatgaagacgatgacggtattcgtcactaattaagcgttgacgacaaaggctgcgttacctgatgcgctacgcatatcaggcccaggtagttcctgcaacctggtgaatttgtagcccggataaggcatttacgtcacatcctgcatactcaaaaagcacgtggttaatgttcgaatgcccgcgagtctaagctcgcgggcatttttcaaagtttgcgtagcatccgtacttcacaatcgacatgacccgtgcagccaagcgcatagtcgatatgctcaaagcccaaatgctcataaagcgcaatggcttcctttaaaaaagcggtcgtttccagatagcagcgtttgaaacccatttctcgcgcctgctccattgccattaaggccagtttttttgccagccctttgccgcggatagccggaagaaaatacatcttttgcagttcgcaaatgtctgactcactcccggttaatggcgcaatcccaccgccgccgaccacttcaccctcgtactcaaccacccaatatgcgtggccaggctgactatatacttgatacagctcgtcaaggttcggatcggcgacggtgtagcctttatcagcggtaagaccgtattcggcggatacctgacgaatgacgtgggcgatagcaggattatcggcgacggtaagtttgcgcaaacggagtgcgggagaagcgacaacattcatagcatagctcaatttcaaatgtatgatttatagctcactttaataccaccctcgcttaggtggtgcaagaagaagataaatcagaaaatattacgcatatctctctgagataaagcgtattctaggcgaaccagtatcaattgactggaattattatcggtatgaatggaatttattttagggatatagttcatgaatgatgtaaacatcgggaaagataattctcggcactcgtttgttttcacaggcaaaggtggtgagtattttcttatttgtcttgtgaatttttcactgacaattattactctgggaatatatggaccgtgggcattgataaaatgccgtcgttatatttatcaacatgtgacactcaaggggcaaccatttagttataagggaacaggtggtgccatttttgttagcatgttacttattgtggtggtttatcttctcagtatttcttgttttgcaggtcaacactttgcgctcggtttattcctgtttgctctcttgatctgcggtattccttgtatggcagtgaagagtctgcagtatcaggcgaacatgacctcactgaatgacattcgctttggctttaactgctcaatgatgcgtgcatggtgggttatgctaggactgcctgttctgttggcgttagttttttggttcgcactgtatcttattgcacaagtgacgacatcgataggagggttattctttaacttagtcgcattaagtttgctttctgccatcgggctaggtgttgtccatggtataacctatagtaaatggatgccattgctgggtaataatgcaacttttggcattcataagttttctattcaggtaaacgtaaaagaatgcattaaaggttgcatgctcgcaatattaaccatggttcctttcatcattgtgattggtattatgatcgcaccagtattccagcagttaatgatgatgaccatgttgggtaggtctgatgctggcagtgagtttgtattacaatattacccgcagattatggcttcttatttcctgtattttgtcgcgatccttgtttttgccagttatctctatgtcacgttacgcaatctgtttttgaataatctgacgctggcaaatgggacaattcgttttcattcatctgttaccgcgatcggtatgcttctgcgcatgttggcggtattaatggggtcctcaattacctgtggtctggcttatccctggctgaaaatgtggatggttagctggattgctaacaatacccatgtccagggcgaccttgattcgctggagttaaccaatgatgacaaaccgcaggatagcggttcgttaatgtggatatctcgcggtattatgccgtatgttccgtttatctaaataaaaaggccggagcatgctccggccttcgttttcactatgagtattacagcgcggcgataacagcctgctgttcaatcagcttcgctttcgcttctgcgtagccttccagcttctcacgctctttcgcgatgaccgcttccggtgcgcgggcgacaaagccttcgttcgccagcttgttctcaatacggctgatttcgccttcgatcttcgctacttctttcgccagacgtgccagctcatcttctttgttgatgaggcctgccatcgggatcagcagttctgcgccgtcgacgatctttgtaacggaaaccggacctttatcatcagcaggcagcacggtgatgctttccagacgcgccagcgtttgcaggaagccgcggttttcatttacgcgacgttctgcatccgcgctgcaaccacgcagcagcagctccagcggtttacccggcgcgatgttcatttctgcacggatgttacgtacagcaacgatcgcctgtttcagccactcggtgtcggccagtgccgcttcatcaacctgagacgcatcgtactgcgggaacggctgcagcatgatggtgtcggcagtgataccgcaaagtactttcacgcgctgccagatggtttcggtgatgaacggaatgatcggatgcgcgaggcgcagcagaccttccagtacagtcaccagcgtatggcgagtaccgcgcagttcggcttctgttccaccgttcattaccggcttggtcagctccagataccagtcacagaactggttccaggtgaattcatacagaatgcctgcggcgatatcgaagcggaagctgtccagcgcttcgcggtacgctttgatggtctggttgaactccgccagaatccagcgatccgccagcgacagcgtcatttcaccgccgttgaagccgcaatcctgaccttccgtgttcatcagcacaaaacggctggcgttccacagcttgttacagaagttacggtagccttccagacgcttcatatcccagttgatgtcacgaccggtagaagccagcgccgccagggtgaagcgcagcgcgtcagtaccgtgcggctcaatgccgttcgggaactgcttctcggtgcgcttacggattttgtccgccagctgcggctgcatcatattgccggtacgtttttccagcagttccggcagcgaaataccgtcaaccatatccagtgggtcaatcacgttacctttggatttggacatcttctggccttcgtcatcacgaatcaggccggtcatgtaaacggtgtggaacggcacctgcggtttgccattttcatctttgatgaagtgcatggtcatcatgatcatgcgggcaatccagaagaagatgatgtcaaaaccagataccatcacgctggttgggtggaactggcgcagtgcgtcggtgttttccggccagccgagtgtagagaaagtccacagcgcggaggagaaccaggtgtcgagaacgtcttcatcctgacgcagcgcaacatcagcaccgaggttattttctttacgcacttcgtcttcgttgcggccaacataaacattacccgcttcgtcataccatgccgggatacggtgaccccaccatagctgacgagagatacaccagtcctgaatatcgcgcatccaggagaaatacatgttttcgtactgcttcggtacgaactgaatgtcgccattctcaaccgcttcaactgccggtttcgccagtacatcggcacgcacgtaccactggtcggtcagcatcggttcgataaccacgccaccacggtcgccataaggaacggtcaggtcgtgcggtttaatttcttccagcaggccgagcgcgtcaaccgcagcaacgactgctttacgtgcagcaaaacgctccagtttctggaactctgccgggatttcgctggaataaacgtcagattcgttacctttggtatcgaacacctgggcgctttcacggatatcgccgtcaaaggtcaggatgttgatcatcggcagggcgtgacgtttaccgacttcatagtcgttaaagtcgtgcgctggggtgatcttcacgcagccagtgcctttttccatgtcggcgtgttcgtcgccaacgatcggaatacgacggttaaccagtggcagaatgacatatttgccaatcagatctttataacgcggatcttccgggttaacggccacgccagtatcgcccagcagggtttccggacgggtagtcgcaaccaccagataatctttaccgtctgcggttttcgcgccgtcagccagcggatagcggatgtgccacatcgaacctttcgattcgcggttttccacttccaggtcggagatagcggtgcgcagtttcgggtcccagtttaccaggcgtttgccacggtaaatcaggtcttctttatacagacgaacgaaaacttctttcaccgcattggacaggccttcgtccatggtgaagcgttcacgctcccagtcgacggagttgccgagacggcgcatctgacgggtaatggtgccgcctgattccgctttccattcccagattttgtcgatgaaagcttcgcggccgtagtcgtgacgggttttaccttcttctgcggcaatcttgcgctcaacgaccatctgggtagcgatcccggcgtggtcagtaccgacctgccacagggtgtttttgccctgcatgcgctgatagcggatcatggtatccatgatggtttgctggaaggcgtgacccatatgcaaactgccggtgacgttcggcggcgggatcatgatgcagaaactttcctggctttcatcgccattaggcttaaagtagccctgcttttcccagtgctcgtaaagcggctgttcgatatcttgtgggttatatgtcttttccattatttccaggttgccgtattcaggttgaaaccagccacgcggtaggctttatagcgttcgcgcgccagttgtttcagagaatcttcataaggaacgaagtctaccacttctgtgaaagcggtggcaaaatctgcaaagcttgttcgcagactaatcaatatatcgcgcgggctgctgctgcgcttttgcggccaggcgatctccaccggcgcaccgccgcgcggtccttctcccgctaaattatgcggaacaaagctttctgccggacgcgcccacagggcttcatccagtcggtaagcctgcttttcatcttcacaggcgatgagtacgcgcttaccactgcgccaacgttctgcggcaatttcacacaccaactgctcaacggcgcttaagccatcgacggtggtgtcattgtccagaaggtagaacgttgcgtttttcatatatggggcttcttgtggtggatttaaatacgcatcaggtatacaccgcagcgcctgatgcgacgctgccgcgtcttatcaggcctacaagttaagtgctgtgtgtaggtcggataaggcgttcacgtcgcatccgacaataacagccttgcctgatgcgacgctgtcgcgtcttatcaggcctacgagttcagtgctgtgtaggtcggataaggcgttcacgccgcatccgacaataacaacacagcctgatgcaattactcttcgccgttaaacccggcgcggtttagcaggaactgtgccagcaacgccaccgggcgaccggttgcgcctttcgccttaccagaacgccaggcagtaccggcgatatccaggtgcgcccagttatacttacgggtaaagcgcgacaggaagcaacctgcggtaatcgccccaccaggacgaccgccaatgttcgccatatcggcaaaattggactccagttgttcctggtactcgtcgcccagaggtaagcgccatgcacggtcaccggattgttcagacgcggcaatcagttcatgggccagtgggttatggttcgccatcagaccagtaatatgatgacccagcgcgatcacgcaggcaccggtcagcgtcgccacgtcaatcaccgcttccggctcaaaacgctcaacgtaagttaacacatcgcacagtaccaggcggccttcggcgtcggtattcagcacttctacggtttgaccggacatggtggttaacacatcgcccggacgataggcacgaccgccaggcatgttttcgcagcctgccagcacgccgataacgttaatcggcagttgtagctccgcgaccatacgcatcacgccgtagaccgctgccgcaccgcacatatcgtacttcatctcatccatgccttctgaaggcttgatcgagataccgccggagtcgaaggttaaacctttacccaccagcacgattgggcgtgcatcttccgacgcgttgcctttgtactcaatcactgacatcagcgattcgttttgcgaaccctgaccgaccgccagataggaatgcatccccagctctttcatctgctgttcgccgataacgcgggtgatgacattcttgctgtagctgtcagccaactggcgcgcctgagaggcgaggtaagcagcgttacagatattcggtggcatattgccgagatctttcgcggctttaatccctgcggcaatcgccagaccatgctggatcgcgcgttcaccgctggtcagctcacggcgggtcggcacgttgaacaccattttacgcagcggacgacgcggttcgctcttgttcgttttcaactgatcgaaactgtagagcgtctcttttgccgtctcgacagcctgacgcactttccagtagttgttacggcctttaacgtgcagttcagtcagaaagcagaccgcttccattgagccagtatcattcagcgtattaatggttttctgaataacctgcttgtactgacgctcatccagctcacgttctttgccgcaaccaataaggagaattcgctcggaaagtacattcggcacatggtgcagcaacaatgtctgccccggttttccttccagttcgccccgacgtagcagggcgctgatgtacccatcgctgattttatcgagctgttctgcaatcggagaaaggcgacgtggttcgaagacgcccacgacgatgcaggcactccgctgtttctccgggctaccgctttttacactaaactccatgcactacgctcctgaatcttaaagacaacggcggtggctacagatagaattgcaagctttcgtaactcatgtccgctgttgcgatgacttcgtgttaatcttaacgttattacggcattggcacgtcagaacaaaatctgagaggtgaatccgttgagtataattatcttagcgacgatttcgacgactcaagagaataaatgacgtttaagccatgaaacaagctaaaatcctgcaaaagacgagtttttacgggcgtatttaaagtgataatcataagatatctggtgcgggagacgctcaaaagccagctggcgatactcttcatcttgcttttgatcttcttctgtcaaaagttagtgaggatcctcggcgcagcggttgacggcgatattccggcgaacttggtgctctcccttctcgggttgggcgtgccggaaatggcgcagcttatcctgccattaagcctgttcctcgggctgctgatgacgctgggcaaactgtataccgaaagtgaaattacggtaatgcatgcctgcggtctgagcaaagcggtgctggtgaaagcggcaatgatccttgcggtgttcacggcaatcgtcgcggcggttaacgtgatgtgggcgggaccatggtcatcgcgtcatcaggatgaagtgttagcagaagcgaaagcgaaccctggcatggcggcgctggcgcaagggcaattccagcaagcgactaatggcagctcggtgctgttcatcgaaagcgttgacggcagcgatttcaaagatgtgttcctcgcgcaaattcgaccaaaaggtaatgcacgaccttctgtggtggtggccgattccggacatttaacccagctgcgcgacggctcccaggtcgtcactctcaaccagggaacgcgcttcgaaggcactgcactgttacgtgatttccgcattacggatttccaggattatcaggcgatcattggtcaccaggcggtggcgctcgacccgaacgataccgaccagatggacatgcgcacattgtggaacactgacaccgatcgtgctcgcgcagaactgaactggcgtatcacgttggtgttcaccgtgtttatgatggcacttatggtcgtaccgctgagcgtggttaacccgcgtcaggggcgcgtactatcgatgctgccagccatgctgctgtatctgttgttcttcctgatccagacctccctgaaatcgaacggcggtaaaggtaagctggacccgacgctgtggatgtggaccgttaacctgatttatctggctttggcgattgttctcaacctttgggacaccgtgccggtccgccgcctgcgcgccagtttttcgcgtaaaggagcggtgtgatgcaaccttttggcgtacttgaccgctatatcggtaaaactattttcaccaccatcatgatgacgctgttcatgctggtgtcgctgtccggcattatcaagtttgtcgatcagctgaaaaaagccgggcaggggagttacgacgcgttaggcgcaggaatgtataccttgctgagcgtgccgaaagatgtgcaaatcttcttcccgatggcggctctgcttggggcgttgcttggtcttgggatgctggcgcagcgcagcgaactggtggtgatgcaggcttctggttttacccgtatgcaggtggcgctgtcggtgatgaaaaccgccattccgctggtcttgctgacgatggcgattggtgaatgggtcgcgccgcagggcgagcagatggcgcgtaactaccgtgcgcaggcgatgtacggcggctcgttgctctctacccagcaaggtttatgggcgaaagatggcaacaacttcgtctacattgagcgggttaaaggtgacgaagagttaggtggcatcagtatttatgcctttaacgagaatcgtcgtctgcaatccgtacgctatgccgctgccgcgaagtttgacccggaacataaagtctggcgtctgtcgcaggttgatgaatctgatttgaccaatccgaaacagatcaccggttcgcagacggtgagcggcacctggaaaaccaacctcacgccagacaaactgggcgtggtggcgctggacccggatgcactctctatcagcggtttgcacaactatgtgaagtatctgaagtcgagcggtcaggatgccggacgttatcagctcaacatgtggagcaaaatcttccagccgctatccgtggcggtgatgatgctgatggcgctgtcgttcatctttggcccactgcgtagcgtaccgatgggcgtgcgtgtggtcactggtattagcttcggttttgtcttctacgtactggaccagatcttcggcccgctgacgttggtttacggcatcccgccgatcatcggcgcactgttgccaagcgccagcttcttcttaatcagcctgtggctgttaatgagaaaatcgtaaccgaatgaacgaataaagggagcgaaagctccctttattattgttagcaaagtgtgtttcgttcatgcctgaaagatcatgaaaattcaatatattgcagtagtgtaggcctgatgcggcgcgccagcgtcgcatcaggcaaagacaaatcgcacctggcttaccttcttctcccccccagcaaactccccaacatcccgcgcacaatctgattcgtcacctggcgggcggcgctttttgccattgtttgcaccacaccatctttcttcccgccgcgtggtccggtagtgccaaacaaaatatccttcaatccaccgagaataccgtcatccaccgccacctctttccctttcgcgggaggattattttgctgctcgatactggcctgaaagcctttttgcaacatctcataggcggattcccggtccacgtcatcctcgtacttgccatacaccggggagtggttaatcaagccattgcgctcatcttccgtcaccggccccattcgtgaacagggggcaatcaccatcgcccgttccaccactgaagggcttcctttcgcatcgagaaacgagattaacgcttcgcccgtccccagttcctggattgccttttcggtatcaaatgttggattggcccgcatggtttgcgccgctgccttcactgctttctgatctttaggcgtaaaagcacgcaaagcgtgttgaacgcgattaccgagctgcccgagcacgttatccgggatatctgacgggttttgcgaaacgaaccagacgcccacgccttttgagcgaataagccttatcacctgctcaatcttatccagcagtacctgcggtgcatcgttaaacagcagatgcgcttcgtcgaagaaaaacaccagttttggtttctccagatcgcccgcttccggcaattgttcatacaactctgaaagcatccacagcaggctggcggcgtacagtttcggcatctggtagagcttctcggcgctgaggatattgataacgcctttaccgttggcatcggtgcgcatccagtctttgatatccagcatcggctcaccaaagaagtgtgctgcgccttgctgttccagcgacaacagcccgcgctggatggcaccaaccgatgcactactgatattaccgtactgattctggaaggatttggcgttatcgccgatgtactgggtaattgcccgcagatctttaaagtcgagcagcaacaatccctgatcgtcagcaatgcggaaaatgatattcagcacgccagattgcacatcgttgagattcaacagtcgtgccagcaacagcggccccagatccgaaaccgtcgcccgcaccggatggcctttctcgccaaagatatcccacaccaccaccggattagtatgaggttgccagtcatttacgccgatatttttaagccttgcgagcagtttttccgaagatgtaccttcctccgcaactcccgttaaatcacctttcacatcagccataaacacaggcacgccgatttccgacaatgactccgccagtttttgcagcgtaacggttttacccgtccccgttgcgccggtaatcagcccatggcggttagccattcccggcagtaaaaacagttctgtgtccggcgtgcgggcaattaacaggggttcgctcatgagatttcctccagtttcctgcctggagtataggcaacgtccggcaaagagaatatgtgtaatgcagagaaaataacctaaagcgtgttaccgtgataaatctgatacccgaggtcaacagtgttgtggttgtgatcgttattcttaattttgctcagcaacatttgggcggccatccgaccaatatcaaaacggggagtaattacgctggcgaggcttgggatcatttgcctgccaatctccagcccatgaaaacccgcaatggaaatttgttctggcacggcgaggtttcgctcgcggcacagcagaagcgcacccatcgcaatatcgtcattggtgcaaaatacaccgtctaaatccgggtttgcgctaagggcatcacgcattaactgcattcctaaatgaatggatgagatggcgcgtggattcatgcgtaatggggaaagattatgcagcatcatcgcatcgcaatacccctgataacgctgttcatcgcgggtgtcatctttggaaccgagatacagaattttgcgcctgactcgcttatccagcatggtacacaccatgtcaaaagcagcctgccgattatcaaaaccgacctccatatccagccgttctccctgtacatccatcaattccacgaccggaatggtggctgaacgcagaaatttcaccgtcctgatggtgtgatatttttccgaaagaataatcccgtcaatgttataagagagcaggttaatcaccgactcttcttcggaatcgcgatcgtaattgtaattagcaataatggtctgataattatgcacagaggtgacggattctattcccgcgagaatgtcagcgaagagttgattttgaaatgacggaatcaagataccgagggtataactttgtgcattcaacaacatgccgggagcgcgattagggatataattgatctcttccataattttggcgatgcgctcgcctgtttcctttgccacctttttcggcgagcggatataacgactcacggtcatttttgttacgccagccagcgtagcgatatcctgtaaagaaattctgtgattgcgcataacttctcccaacgtcgggggaatcttcaatcttcccccgaaactacatcacaatattttattctttcagtgcaatacgacgttaatggctaacacgcccagcaaacccataatagaaataagggtttccatcaccgtccaggtacgcaacgtttcaccaaccgtcagattaaaataccctttaaatagccagaagccagggtcgtttacgtgtgacgcgatcacgctgcccgcaccggttgccagtaccattaaagcgggatcggcatgggtaacgttgataatcggcaacaccacacccgcggtggtaatggccgcgacggtggcagagcccagagcgatacgcaacagcgccgcgacagtccagcacatcaataacggcgaaagtgtagttccggtcattaagtgtgaaatatactgcccgacaccgctatctactaatacctgcttaaacgcgccgccgccagcgataataaacacaatcatcgcgatagcgcctatagaatccccaatgatatccatgatttgctcgatggtgcgtccattacgtcggcccagtgtgaaaatcgcaataacaatggcaataaacagcgcaacggcagggttaccgacaaattcaaagaagaggcgcacggtgttagttttcggtaacgtaatttcacaaacggcggcgatagccatcaggatgaccgggatcacggcagcgaaaatactgttccagaaggagggcatctcctcttcgctaaacagatgaggattaaataagccttccggtggtgctttctcaaagcgagttagcagtttagaaaacagcggtcctgcgacaataactgtcggaatggtaatgataaatccatacagtaaagtcgttccgagattagcctcaaagatagtcgcgatggcagtaggccctggatgtggcggcagaaaacagtgggttacagagagcgctgctaccatcggtacgccaacatacaacaggggtaatccagatgatgccacgatggtaaataccaacggcaacagcaggacaaagcccacttcaaaaaacatggcgaggcccacaaccagaccggtgatcactagcgcccattgcacgcgttttttaccaaaagtggcaatcagcgtagtggcgatacgttgtgccgcacccgtatcagaaatcagcttgcctaacatggccccgaaaccgaggatcattgccagcccgccgagcgtgctgccgataccattttgtatagagtgcaggacggcctgtgcatccatcccttcggcaaatccgacgacggcagcgaccagaacgagggcaataaagccgttaactttaaagccgatcatcaggataagaagcagcgcgacgcctgccgcaataatgattaatggcatagtctttatctcttattagtgccagaaaagcagcgctttcgcgctgcacgtagggtagtaggtgttaaacagccactaacatgccgccatcaacaaacaacaggtggccgtttacgaaatcagaggcttttgaagaaaggaacaccgcagcaccaatcagttcctgcggatctccccagcgtgcggcgggggtccgtttgcacaaccaggcggtgaaggcttcgtcctcaaccagtgctttagtcatttctgttttgaaatagcccggcgcaataccgttgacctgaatattgtggcgcgccagctcgacgcacatgccgcgggtgagcatttttaccgcccctttcgatgcggcataaggggtgatggtgtcacgtcccagttcgctttgcatcgagcaaatattaataactttacctgccttgcgttcaaccatgtgacgagttaccgcttgcgataccaggaacacggcggtctggtttactgcgatcacatcattccactcttgttcagggaactcagtaaaaggatgacggcgctggataccggcgttattcaccagcacatcaatggggccgatgtccttttcgatatgttcaacggcggcatcaatttcatgtttatgagtaacattaaaaggtgcggcaacggcctgaataccctcctggtggagtttttctacagcaagttctgcgcgttcggcagtaatatcattaataattatttgtgcgccatatttacccaggccggttgccagtaaaaagccaatgccctgtgctgaaccggtaatcaagatattttttcctgccagtgaaaatagatcgttcattgtattattcctttatttatctcttagaaaacaagctggacttttgctgcctgggttttatcaccggcgaaacgtagcgcctcttccaggtctgtgaagggatattcagcactcagtaaaggcagtggattaataacgccattcgccagccatgacactgaggtattaaattcgctggtaaaacggaaagagcctttgagtgaaatctccttaccaatcaacgtcatcattgggaattctgccatcgcgcctcccatccctacctgcaccattacgccgcgtgcacgagtgacctccagacaggtattcactgatgaaggatgaccggacacttcaaagctgacatcgaaatagcctttttccgctttccagtgatccatgtcgtcgttttgtgggtttacgagcacatccgcccccatctctttgcccagcgaaagggaacggggactcacatcggcacagacaatttccgcggcccccagtgttttaacagcactgacaatcaggcagccaatgggcccaacaccagaaataaatactcgcttgccctgtaactcgccggcctgatgtgcggcatgaatcgcgacggctaaaggttcggcaaaagccataaccttttcgtcagctttggccggataagggacacattgcgacgtttcgaccattttataacgggtaaagccaccatcaacatgagggaaatacatggcactgccaaaaaaacgcatctctgtacactgattctcgttatgttcaatgcagtatttgcagtgaccgcacggtttagacggattaatggctaccgtttgcccttcatgtaattttgatgagtcgctatgaataactttaccgataacttcatgacctaacaccatcggtgcctttatcatgaaattacctacttttccttcctgataataatgtaaatcggaaccgcaaattccacctcgggttatttgtactaatgttccattattattccaatctatcgtctgctcggtaacggcaacagttttcttgcccgcaacaacgcaggactgtgttttcacttgcataaattcctcactggtcaggtagacacctcggaagcatttaagcggttttaattgtcattatttgtgatgaagatcacgttagaaaattgttacattacgatgttacgcataacgtgatgtgccttgtaattcttatcagcagaaataaaaaaacgtgaaattattatgccaccaggcgtagtatcgcagcaggtaagatgattcaggagattttaaatggcgggtgaaagctttattttgatgggcgtttcagggagtggtaaaacattaattggtagcaaggttgccgcgttattatctgctaaatttattgatggtgacgatcttcatccagccaaaaatatagataaaatgtcgcagggtattccattatctgatgaagatcgacttccctggctggaacgcttaaatgatgcttcatacagtctttataaaaagaatgaaacaggatttattgtctgttcatcattaaaaaaacagtatcgtgatattttacgcaagggtagcccccatgttcatttcctctggttagatggcgactatgaaactattctcgcgcgaatgcagcgtcgggctgggcattttatgccggtagcgttactaaaaagtcagtttgaggcactggagcgtccacaagacgatgaacaggatattgtgcgcattgatatcaaccatgatattgccaatgtcaccgaacaatgtcggcaggctgtgctggcgatacgacaaaacagaatatgtgcgaaagagggctgcgcctcagatcagcgctgcgaatgattttcaaaaatcggctttcaacaccacgcggtaacgcgccttaccgtcgcgcacatgctggatggcgtcgttaattttcgacatcgggaacagttcggtagtcggcgcaaccttgctgcgggcggcaaagcgcatcagcttacgcaactcataaggtgtaccggtagcagagccagagacactgcgatcgcccgcaatcagcgtaaaggccggaaccggcaacggcgtgagaaccgcaccgacggtgtggaaattaccgccatacgtcagcgcctcaaaataaggctgccagtcgaggctgacgttcacagtattgataatgagatcaaactgccccgccagagttttcagtgcctgcggatcgcggctattcaccactttatcggcacccatcgccagtacttcctgctctttcgccggatttgaactaaaggctgtcacctcgcatcccattgcgtgcagaagttttatagcgatatgtcccagcccgccaataccaattaccccaacgcggctggtagcagtgatatggtgcatcaacagtggtttaaagaccgtgataccaccacacagcagcggcccggcggactcgatatcgatattttccggcagtgggatcacccattgccagtctgcacgcaacttctcggcaaaaccgccgcgattcataattgttggcaccgcaccttgctcgcagttgatctgattaccgctaatacaggcatcgcaatgcccgcagctacgcgccgtccagccaatcccgacacgctgaccgacctgcaaacctttatcctgcgcggcgctcccgagcgccaccacgcgaccaatcacctcatgcccggcaatcagcggatattgtgaaaatccccattcattgtcgatcatcgatagatcggaatggcagatcccgcaataatccacctgcacttcaacatcttgtggcctcagctcaccgggatcgtactcataaacttccagttcgccgcccgcttcttttgcggcatagctttttatcatcgacattttttggtccttctctggtgttgtctgggaagtgtagagcatggcagggcggggtgcctggagtgtgacaaaggttacacatcgcggtatgcaatgctgaaaatttcagcacttagcgaggtgcgagcaagctggcgcttgcatggtggcgtgcgacaggtataatccacaacgttttccgcatacctcttcagtgccgaagtggcgaaatcggtagacgcagttgattcaaaatcaaccgtagaaatacgtgccggttcgagtccggccttcggcaccattcttacttccaagaccatccgagaaagtccaaatatccctttaaaatcaatgcttgcagcgattttttcgtcctgcgtcttccgaggttgtccgttgaaatccggatatcattgggggcataattgggggcatcttaacttcgattagaaatgtgcccccaaatgaagctcaacgccagacaggtcgagaccgcaaagccaaaagacaaaacctacaaaatggccgatggtggtggtttgtatcttgaggtttcggccaaaggttccaaatactggcgcatgaaatacagacgtccctctgacaaaaaagaggatcgtcttgcgtttggtgtttggcctactgtgacgcttgctcaggcaagagcaaaacgcgatgaagctaaaaagcttttagtacagggcatagacccaaaagtcgtacaaaaagaagctcgggccgagaattcgggggcatatacttttgaagctatcgcccgagaatggcatgccagtaacaagcgctggagtgaagaccatcgatcgcgcgttcttcgctatcttgagctttatatattccctcatatcggttcgtccgacattcggcagcttaaaaccagccacctgttagccccgattaaaaaagttgatgccagtggcaaacacgatgtcgctcagcgcctgcaacagcgcgtcacagccattatgcgttatgccgtacagaacgattacatcgactcaaatccagccagcgatatggctggtgcgctatcgacaaccaaagcgcgacattaccctgctttaccttctagccgattccctgagtttcttgcacgtcttgctgcatatcgtggccgtgtaatgacacggattgcggtcgagctttccttgctaacttttgtgcgttccagtgaattacgtttcgcacgttgggatgaattcgacttcgataaatctctttggcgtatacctgcaaagcgagaagaaattaaaggtgtgcgttattcgtaccgaggcatgaagatgaaagaggaacatatcgttccgcttagtcgacaggcgatgattttattaaaccagttaaagcagattagtggtgataaagagctgctttttccgggggatcatgacgcaactaaggttatgagtgaaaacacggtaaacagcgcattgcgtgcgatgggctatgatactaaaaccgaggtgtgtgggcatggatttaggactatggcgcgtggtgcgttgggggagtcggggttatggagtgatgacgcgatagagaggcaactgagccactcagagcgtaataatgtacgtgcggcatatatccatacctccgagcatttggatgagcggcgtttaatgatgcagtggtgggctgattatttggatatgaaccgtaataaatatattacgccttatgattattcaaaatacaaagaaatacttaaataaaaatagttattggttgatttttaaaatgagtgttaagtaacataatctggagtttttaattgttagttgctataataaaaatcaacgtgaagtgagtgtgattaacatggctgagttattgcgagagcaggaagttaaaatagccctaattgaatggttatataaaaaaggcatgcttagtgatgcaacgatcattaatgaaatggttgttgctaactggagcagaagagctgatttggctattgccaatggaagcctacaagcttttgaaataaaaagcgattttgactctcttaagcgattggatggtcagttaaaaatttttaaatctagcttcgaaaaagttacaattgtgtgcgcgccaaaatttaccagtgaagtatctaaacgggtttcatcagatgttggcgttgtagaatttcaatctaataatagtagcgtacgctttaaaataattcaaaaaggaagggtttgctctcgcttaaataaatttgtttatttgggttttttgcttaagtctgagcttaaagatctgcttaatcagtatggaattacattttcaaatgaactacatagggattgtcttgaggttttggcatctaagttatctttaaacaagattagagaatttgtcattacatctattaaaaataggtatcatgcgacatctaatgattttttatctagactccatggtaatcaagaaatatctataaacgatcttgccttattgagcaaagctaaaagaaggaataattctttggttaagtttgagtttaaggnnnnncattccattcattaattaattaatgaatgaatgnnnnngctccccaagagtcctcccttggataatgtggatactctgccaaaattgatttcgcagcttcaatgaacccttctttattcatcccagggcggcgctcgaaataccatgaatcatttaacgctatatcaattctaggaacatatcgcccaattatgttgtcatacactactgaatgaattgaaccatgatcgccataaatagcgacatcacttccaccaatattttgatgcaattctctctcaataacatcaatatatccggactgtccattttcacggcaaaaatttgtaactgaactagggaagcttgttgctagcacactaattatggcttcaggaatctcagttctaatctgattaatcgaatttattgctgcagctgttatagcagatacattccctctaatgtagcccaaatctatgaaaactatggcattttctggagagttcatcgatactagtgacgtcagggttttattaatgtctgtatttagatttctaattctaaatgcaattgaacctttaagttcctctaaaaccctggcttggatagatatatctctaagttttgctgaatccggcatctggactactggaataatattatcatttctggaacaaaactctatccagtttttaaaaccattctcaggagagagtagttcgaagcttgacgcgcaatgatgagaattatcctttgtgacatccaaaataaatgggagattactcatcacttctaaacttttatctaacgatacctgtatttcttccgagcgaggccatttccccaaagaaattaaaggtaatatttttttcttattctcatatgataaattattcagtccggtcatttctgctgatcgtgttcttagggctggatagtatgagtaattttcaaaatatactttcatatttaattagcctccgaatcgatattttctggtcggcttgctgttcttggcatagcgttaatttgggggttctgagtagcaagataagcagctatactttccatcttctctttctgttctgaagttcttgcaagttctttaatcaattctttgttttcagccatcaagttttgattggattcattatgactcttgattacctccatattactttttataacattcgtgtggttgttgctaattgctttaatcgttctgtgtgtaaaccatccaataagtaaagcagctaaccatccagaacaaacgagcaaccattgtgaaatatcttggttgcggatgaagctagtagcaatagtgattatggtcccaacaacgccaattaatccatatacatgattcagcatcctttaactctctcatgccacgaattcttaaggatcttgcgacactgacaagaaccaccttacatcaatctattttttacatatttttcaggatagtgccatcaaaaaagacagttttggaccataggccatagattttcttcattatgctccaatgtattaacgaggtatgtactgaaggcactttgactacacaaataattaactaacttgtcggtttgcgcgcggtgctttccccgcctcgcccgcccgctttgtagggcggttttaatgcagttgcacagtcacgctcaggctgcgccgggaatggcgcggtctgcagaaaatgaggcaggaaaacgcatgcaaagccatgcaccttatcgatgcatggcttttttcagtaaaaacgggcggattttcggggaattttacacagactgacgtgatgccagttgcgcacttttacgcgaaaaaatcatgttctgcgcaggagtgaatttttcacggctgtcatccaccgaagccgcgtcaggcctgaatccgatggccgttaaaatgtcgctatcctgtgcggaataattaattttttcccccttcgcaagccaggacagaagggcttcacgcagggcatctgtggcacgctgtatggcacagtttcgggcaatggccgtcagctcactgtagcccatcagctccggtgccagtgccgccgccagtgctgtgccgtgctgctgcataaaatcattcagccggtcgcggatgctgatgtgctgaacggcttcatgcgaacgaatataacgaccggcggcctgattcacctgccattttctgacttcgataatattgcgtaattcgtcaaggcgactgacgtttctgccttctcctgacagaagccgcagatattcctgttcggccgcagccagctcatttttgcgttgcagccatgctgctttgttattctgacacgtgtcaaaggcctgctgtaaggctgtgctttccatcgttatctctttctcatcatgctgaagaataaaaatacggtgtgcggcgacggccggtgttaaccggcagccctcattccagacgcagcgaatatgattgtgtttttaaccgtactggcggcagttcctgtttttcatgcaggcgttctgccagttcgtccggtgtgaccgggcggacaatgaagcggttgatggtctgaagcgttttaaacaccagaccacagcccggatccgtgcacacataaaaacgctcggtgacttcctgagacagacgccgcgatgttcttgacagtgcaaggcctttacatctccgacaacaatatccggtaacaagcattcttttcgggcgtttcatgctaccggaggctgacgtcagtgaatcgcggtatctctgtttgcctgaaatgtattccattcctgaatctttacagtcagagaaaaagctttcactcgcttcaaatgtcgcagagcaataaatattccggcactgtgcaatcattatcttggtgccatcgtccatgaaatgtgcgcggcgggtgtgagcaacatgtccacacgacgggcagtaaatcatgacagcagtcctctggccttaagctctgctccctgctggtctattttgtcctgccacaccttgcgctgtgccggtgtgcctgccacctcataatccatgtgcgggagtgttgccgctgacagtccggtcagccggagaaccggctcgccggtgaggctgatttgcatctgttttattttctgttccagcgatgatttcacctgctgcatgacagctttatcgggtgcgatgtagccctgatggccggtggtgttggcgagcggattttcctgtaccagaatgctcagatgcattgcccggacaagcgcctcacaggtttcattcagggcgtgttccagctcatgccctgcatacagactcagaaggtgatgatgtgccttccggtaggcggtggccgtgctgtcacacgcccctttcaggcgttcacgttcgaaattcagcaccacggccagattgtcatattcctgtaccagctcccggcgtgccacgcgctcaatgtggcgctgtttcagctcgtcgctcaggacaccaccggctgcacgaaaggccgtgcgccagtcgtcagcgtcgtttccgtcggcctgcgtcagcgcatttttttcctgctctgcccgttcaatggccgtgacggtctcatccatcaggcgggcgttctcaaggtgggcggctctggccttttccagttgtgccagtgcgggttgcagatattcagggatggtgttgtcagacattttccggctcctcgtcacttcaggttgagaaaattgtgacgtacaccggacaacaacacgacgcattgcagatgtgccagccctgacacaggagactcatcctcagaccggcaagccaggaaaaggtcgcaggaaaaaccggcttactgtttgtttttttatattttactgttcacctctgttcaccataagaaaaaagataagtaatacagtaagttaaagggtgaacaatcgcagtaatgactgttcaccgtctgttcaccactgttcacccgttcatggactttttgtgctgtttattactttttatttttattaattaactgaaataaataagaaaaaacaatttgtatttcactataattttttccagctccttccagagcgttttaaagctatctggcgctgatgtgcaaaaaacacacagccattgtaaggctgccggaacaaatcccccctgttgcgtctgccaaaaatattcacaaaataaagcgctacccgaagccggacggacttatccggtgctgtatggacattaacgaggtagcccgatgcaagctgttttttcttccccgtctcccgcccctgtgacgccactgatgccgctgccggacattacacaggagcgttttttacgtcttccggaagtgatgcacctgtgcggcctgtcacgctcgaccatctatgaactcatccgtaagggggaatttccgccgcaggtgagtcttggcggtaaaaatgtggcctggctgcactctgaagtcaccgcatggatggccggccgcattgccggacgcaaacgggggtacgacgcatgatgatgcctgttctgcaaaaagtccctttttctggcttgcctttttccggcatttgcggatatagtttttccgctgccgcaaaatcggcagccgggcgtggaaacccgagcaattcacaggcgacatatgacgcgccatgcgtctttttttgtgtcgcaatcaacgccacagagcgccagattatggtgtggtgtgtggtcagtcgtgcagatggcattccgtgcatcctgcccgcgtccgctcattatgccgcagagtcaatggtagctcaggcggggcagcctccgggctggccggtatcctgtgaagccggtatttccacccccgtctgggctatcgccatcgagcgtggaaactccggcgatagcgttatttgctattcacaggaggctgccatcatggctacaacccttaccccctcacaccctgaatttgtctttgtgtttgcggctgtccgtcgcacagaccgtcatccccgtatctgtatgcttcgcaccgtcgccggtgatgaacgcagtgcccgccgttcccttgtccgtgactatgtgctctcccttgctgcccgtctgccggtggtggaggtgtcccgtgcgtaataaaaaagcccctcagaccgtctcagcgcgtcatgacgcccgtgaacacctcagcattgaggcttaccataagctcaaccgcgccagcgccgtatcccagtttgttgggggtgatttgattcaccgtgaactctccggcctgcatcagctctacattccgcatattttcagctacctgaatgaagatattgattttgtgctgaatgagctgaaagccaaaggcctgtgccgcgattttctcgcccagcagaaagaccggggagacaggacgcatgtttgattttccccagcccggtgagatttaccgttctgccggttttcccgatgtggccgtggtcggcattctggaagacggtattccgtgggaaatgccgtaccgctgcccggacattgtctggaacccgtaccgccgtaaattcagtatccttgtgcgtatcctcgctgacgggcgcaccacagacatcccgctggggcgttttctgcgggaatttacctgtgaccgtcctgacctgttcaaacgcagccccgtaaaccggcatgcggtactgaaagaaatggccggagacccggaattacagaaatggcgggagaaatatctggatatttacccgcaggacactgttccggccagccgggcggcaccggtggcgcgggaatggcgggaaattccccgcatggagcctgacccggaaaccaccccggataacagttaccgcaattatctgtaattaaaaaacgacacccgaaaaattaaatgtgcgtattcgcgcagggatacgcacgtcttcaggagacgcagatatgccttatcagttaatgcaaccggcacggaatgcagtcatctgtcacagggaggaaaacaaatgaaaacacccttaccgcccgtcttacgcgctgccctttaccgtcgcgctgtcgcctgtgcctggctgaccgtgtgcgaacgtcagcaccgctacccgcatctcacccttgaatcactggaggcggccatcgccgctgagctggagggcttttatctgcgccagcacggtgaggaaaaagggcgtcagatagcctgtgccctgctggaagatttaatggaatccggccccctgaaggccgcgccgtcgctgtcctttctcgggctggttgtgatggatgaactctgtgcccgtcacataaaagcgccggtactgcactgaaggagaacaacaccatgaaaatgaacgtaaccgccaccgtcagccatgcactcggccactggccgcgtattctcccggcgctggggattcaggtgctgaagaaccgtcatcagccctgtccggtctgtggcgggagtgaccgcttccgttttgatgacagggaggggcgcggcacctggtactgcaatcagtgtggtgccggtgacggcctgaaactggttgaaaaggtgtttggtgtttccccgtccgatgcggccgcaaaggtggctgccgtgaccggcagcctgcccccggctgacccggcagtgacggctgccgccggtgctgaaacagacgctgcccggaagaacgccgccgcactggcacaaaccctgatggcgaaaacccgtcccggaaccggtaacgcctacctgacccgcaagggctttcccggccgggaatgccggatgctgaccggcacacacagagccggtggcgtgagctggcgcgtcggtgaccttgtggtgccactgtatgacgacagcggcgaactggttaaccttcagttaatcagtgctgacggccgtaagcgcaccctgaaaggcggacaggtcaggggcacctgtcacacccttgaaggacagaatcaggccggaaaacgtctgtggatagcggagggatacgcgaccgcacttaccgtgcatcacctgaccggtgaaacggtgatggtggcgctttcttccgtgaacctcctttctctggccagccttgcccggcagaagcatccggcctgtcagattgtccttgccgcagaccgtgacctcagcggtgacggccagaaaaaagccgccgcagccgcagatgcgtgtgagggcgttgttgccctgccgccggtcttcggtgactggaatgatgccttcacgcagtacggcggggaggccacccgtaaggccatttatgatgccatccggccaccggctgaaagcccgttcgacaccatgagcgaagcggagttttccgccatgagtaccagcgaaaaggccatgcgtatctatgagcattacggcgaggcgctcgcggtcgatgccaacggccagcttctgtcccgctatgaaaatggtgtctggaaggtgctgccgccacaggactttgcccgggatgtggccgggctgtttcagcgtctgcgcgcgccgttctcctccgggaaagtggcctccgtggtggacaccctgaagctgattattccgcagcaggaagccccctcccgccgcctgattggctttcgtaacggcgtgctcgacacgcagaacggcacgttccacccgcacagtccgtcacactggatgcgtaccctgtgcgatgtggatttcaccccgccggtggaaggtgaaacgctggaaacccacgctcccgcgttctggcgctggcttgaccgtgctgccggtggtcgtgcggaaaaacgcgacgtgattctggccgcactgtttatggtgctggcaaaccgctacgactggcagctctttctggaggtgaccggtcccggcggcagcggcaaaagtatcatggccgaaatagccaccctgctggccggggaggataacgccacatcggccaccattgagacgctggaatccccgcgtgaacgtgccgcgttaactggcttctcactgatacgcctgccggaccaggaaaaatggagcggcgacggtgccggactcaaggccatcaccggcggcgatgcggtgtccgttgacccgaaataccgggatgcgtactccacgcatatcccggcggtgattctggccgtgaacaataacccgatgcgcttcaccgatcgcagcggcggcgtgtcacgccggcgggtgattattcacttcccggaacagatagccccgcaggagcgcgacccgcagcttaaggacaaaatcacccgcgagctggcggtcatcgtgcgtcacctgatgcagaagttcagcgacccgatgctcgcccggtcactgcttcagtcccagcagaactcagacgaggcgctgaacatcaaacgggatgccgacccgacgtttgattttatcggctatctggaaaccctgccgcagaccagcggcatgtatatggggaacgccagtatcatcccgcgtaattaccgtaaatacctctatcacgcctatctggcctacatggaggcaaacggctaccggaatgtactcagtctgaaaatgttcgggctggggctgccggtgatgctgaaggaatacggactgaattacgagaagcgccataccaaacaggggatacagaccaacctgacactgaaagaggaaagctacggcgactggctgccaaaatgtgacgaccctgcaacaacctgacccacctgaccggcatctgccggtcttttttttatcccgacctcccccgaaggtgaacaatccactgttcacccttcaccgtatattcacccgttatcacactgaaattaaaagagaaaaatgaaaggtgaacagtgtgaacaatcaaatcaaaaaaaacttttttctccctgtgcgattttcagtacgggggattaatcaccggtatgagtcacaccggcagaatgccggaggtgaagaatcgaatgttcacccttcacccattattcaccacctatcactctgaaataaaaggagaaaattaaatggtgaacagtgtgaacagttctttcgaaaaaaaattttttatgtggataaaagatgcactggtttggatccgggctacggatccaaacttactgattaaaaattatttaactttccgatttattgatgggctgaaaatagattggtcagaaaaacagtgggggcacaaaagggggcatatttcattgttgtgttttattatttgttttttatcattaacttattttgatatttgagtccggccttcgcaccacaccgtatgcaaatcgagtcgctcaagagcggctttttttgtgtctgaaatcacccatatccgtgcagtatataggcctgccagaaaagcagttcagtattcttcattttgtagtcgatggtcccaagtttgctctggctggaagctgcatcgtccacattacgtgggcagggtggtttcgctatgctacttgaacgttttgaccatgtggctcaggtagctaatatcaaaagacgtcattttgtctccacgcccaccttggtgaacattcaataaatagtttcggtcgagagcagttatgtagggctagcagacgagatgcgcagacatcttgttgaagacaattttactgaccacctgagaacgctattctaccgaataatatttattatcttggtgaataatgatgattacctgtgtaactatggttttatgctgatgggaccggcagtacaatttctgtagtgtactcgcaatttcaggtctctggcgtttattctggtgcaaaggaggtatgtgatgaaaactttgctaccatgccattaaatgcgaccaatatcggattatccatcagttgattgttgtagatttcattggttataaaaatgcaaggtgtaaaagatgaaatttataattattagttaagtggctagttttatagtaatttagacaataggatgtatggaaaaatggaaaaagtttatgataccactagaattagtaatcttgctaacgacccgaaacagttttgttctttttttgtgagtacataaaaagagatgatattagtatagatatcgccttggatgtgctgagaatatcttccatctattataatagattttcagttcagactgaagttgagtataacaatacattcaaaaaatgtattaatgagctagtaaactcatttcctgataacattgaactaatctctgagttcgagagtcaatgtaaaattatgcatgatataaataattctttctttgcggctacaaaatgtgctggtatttggcgtaaaaatacaaaaaaatcacatgcattaatacttaatctcatcatgttttgtgagatgtttttatcatcattatcatccttggttgtggtcaatgatcctaaaaaaatgaagaggatttttccattatttatcgtttctgaaaatattaatattcatgctgaacctgatatcgaatgttttcgagttatcgatagggcatttgatgaggtagccaattacaccggaagaatattttcttatttacggactcatgggccattgaaactaacttcttgtgtgaataaacaaaccttgctttcaatgggagggtaccttaatgagtggaatgtttttgactcattaagcagagtaagagactttttcagactaagtagtgcagtatttacaaaattggataataacatttactctcttgaggttgatagtttttgtttataccgagattatgagattgcaagaaatagactaatgatgagagcgtcacatctatatagcgaagttcatgaatttagtaacaaacattttcatctaaatagttgggtaaaggatcatatgccatcttacttaaattctgatggcgtttttagctcatttcatctaagcgagttggaaaatatgtctcctgatgaccttcatgaagaatatgggaatatatcattatttaattgggtgcacgcttatcaatgtttagtcgagttatctaaagaagaaatgagcaaaagattttcatcgacaaaacctatacccctacagttggatcgctggctgatcataaaaagccgtgagagttggttatcattctttcaacgtaaggggattgcagcagatgcagcaaaaaaactgatagattattttaccttcaattcaaaatcacatgatcttaatgattgcccatttattccctgtatggacggtttatgcttaatgcctgcattaatagcaaatagctcagtgactcgctctctaatgtcattatttggttccaaaaaaatttctcaagcaagtaaagggcgatttcatgagcaacaatttataaaacgagttcgtgatgcggggattaaagcttctccaattgatgctcatgctaattatcagtgtgattgcgtgattctcctggatgattgtttgatttttacagaactaaaatcaaatggtcaaccaatatattatggtaagtactatcagcaagtgtgtaacatcgttggagatagctcattaatacatgatcataataataaatttatgcgttcttattttcaacaaataaatcgaatttctgaacattatcttaatcatcttgatgtgatcattaaagaattcgaactaccatcaacatggcaacccaaaggtgtgtataagcttattgttactacaactatgctcggtgggaaatatcatgtggatgatacatatgtagcggataaatatgcattatctagtttttttcaacgaatacctggagtgatatatcaaacaaatgaaaatggaaaaatggcgaaaaatatcattgatgggtttgagtgttgcgaaggggaaatcactatcgataagtttatagattatctttcctctttgcccagtattaatgctgtacgtaaaaatataaaaaaattaacttatagtgttcgatttaatgaaaaattagtccatcacccttattatgattcttgggcttttggtccatatattcgtaagggaaatgattagagcaatttattatatagtccatgttattcactgattatattattgataatataatcagtgaataactctaatttttttaatgttggggtttggcctgaagttgaaattggtactacggaacggtatgatcatatcgcatcaaaatatcaaggtagtgatgattttctacgcgccgatccagaaacgtggattttatcatcaccataagcaatggcagcgacaacaccatcaatttctatatcaaaggtggtgaaataaattagaaaattgtttatttaatccattagcgataagttttattgttatttagccgagatatattccattgaaaaaagtaaattggcactgatattatatcaaatgggaataatccttttgtaaataagctgaggaatgtgttaattcacatccagcgccttataaaccgcatcaaccggttctgagtaaaaacttacctgaaacttggtaaacaactctgccggaactgttggaatatccatagccgaggatatcggcaacagaactcgttttgcgtcgctatcgaaggcgagttgtaaactagtggcaagatcctgcactgattatgtcagcaatattgaacatactgcgatagttatcaacctcaccccctaaaaacctctttccgatgccactccacaaacccctcaaaagggtaatttttacgcacctgcggcaacgtaatagttttcccgtcaaaatcccagaataatctctcaacgatccctccgccgtttaccgcatctgataccagtacccgcatattttcgtccaggccaatcgatcctttatcaaaggctttatggtgaattgcgcaaagcgccaggccattaggaatttcacaaggaccgccgtgctgtttccattttatatgcgccgcttccaacgcgacggtggtgtcgtcgtggcgcatattaaagccacatatcgcgcactggtatttataagcgcgtaatacatttttgcgaaataacgggtcgcgctgtttacggatttgctggagatcaaaacccagctcgtcagcaatttcttcctgaatactctcggtgaagtgcgcttcgagtatctgttgcgccagggtattgatgagttttttattgccggttaccagggcgtagtgctgttcatcgaaaccgcctgcaacgcggtgttcggtcagttccttcactggcggttgtcggctgctacctgctgttgagcaaagctcggcattgcgtaattgccagaatccgtcgccttgtaatcgccagaacggcatatcaggtcggtactgtgaacgctgtggaccaaaacgttccagtaaactgtgcagaggttcgtagatttccgagccataatcgaaaaggcgtggatgtccattcaggtatcccgctaatacgtatagcaataacaatggtttatgcggcgcgcgctgttcacccttgtgccagatttttatgttggcaattgcctgctgtagcgatttactggaagccattgatatccctggcagtgaaataattgcgatcatgctcgcaaattttctgctgttcaagcctgcaagcgaagatatattaccttgatctcatatgtttttttacttcctgtgtgccctaattgccatgcgatgttgcaccgacgcaaaccaccgtttacgccggagcagttaaaagcgctgatggatgcgaataaatcaaattaatgaacgctcacctttcgcgccaaaactgcaaaattgcttctacaaacctgttagaaataatccctcgacgggctgccgcgctgaaatgactgcttcgcagtgccgtcgtccagttctccggtgaccggtacgctgaaccgtaatatcccgtgcttaaatcgtccgggtcttcatcaggcacgttcgtcagtcctctttcaccttgttgctggaagtcgacgaaaataatattggctaaaacattattttgataattgccataaatagcttcatacgcatgagggaaattttctttccagtaccaggtggtatcgccgcaaaaccacggcgcgtcagtaattttattaagctgagaatggtattgttttagagccctacgaaaggcgtcaaccatatgattaaagtgttgagggtgtgacgcgtagtcactggtcattaagtcaaattcgccttgcatccagcatacgccgaggaatttgttctgcggattttttgccagtgcggctcgcgttctgctgactaaatcctggtatagcggagtatccgatccccaacgacaagcatcatggctggctccgtgcggttctgaatatgtcccttcgctgcccgcggtaaaagctgatccgccacggcaacacggaacgatgagaacccctgcattatcaggaataaagggcagtaatttccgtgctatatgcagtgcctggccaacggtgccgtactgtgtttgatgattcgttgccagaggatggtgataaccctgcatatcctgaacatcgtgtgggcagtgagtcagtggaataatgtcgttaaagtgacatgacgggcctccgggatgtgtatgcgcaaatctcgctaattgtttaattctgggatgaggcgcatcttccttgtccggtaatggtagtccttcgccatacgccatggcattagactgaccagcaacggtaagaacatagtaataatcgggcgatattattgcgttcatataattttcgcgtaatacaaatgacaaattgatagcagggcccctttaccggggccctgaagcgttagttttgtactgtgactttattatccttcacagaaatcaaaactgaatccgtcaccgctttgccgcctgcagtttcaccgccaataattaataaactattattccagggcaatgatactccgtaggcccgaccttgcgataattcgcccgatttatcccatttcccgttatgccaaagatgaatatcagcgctatatgattttttcaggccttcatgcgcatagttcttaccgttctggtaattttctcgtgaacctttgaatccggcccctccggcaaatataagtgagtcattgctcatgcctgcaaaaccgccagcgacgccatctggtgatgcgacgggagcaagcttattccattttaaattattaccggtgaaatcaagttcaaatacggcatccgttcgcaatcctggtttggcttcgccattaataagccaggttttatcacctttattcacaaccgccgcaccagccgttccgtaccagggagattcgccagcgtaactccattgctgtgtagagggatcaaaagataacagaaacttattgaagaaataatcttctgcttttttgtcaaaatagtgggcgttgattttatctatagtggttgaatcttttccagcttcgttgagatcttcaaaatagccattgaagatattctggttaacaccgccagtaacataagccttgccgttgtgtacaaaagtcacatggcccgccatgcccatcggcgcgtgcgacatcaatttaacccagctattggttttggggttgtatttgtgtacgtcattaaatacctgagtcaagccctcgctgtttttgccaatgccgccaaacacatacagattgccatcaataaatgcagaggttgcttgatctctcggtccgccagggaatgcagctaacgccgtccattttttatctttggcctgtgtatccagcttgtaccatgccgtacctgcgctacctaacccaatgtagacagtgtcgttatcaattgctccggtaccacttttaaatggcacaggagtttccggtaatacagacgcgtttgtggcaaatgaagccattatgatagtaagcgccgttattgttttattcattgtgactgtctcctgtctactacagtttaaatgacacaccaatgcgataactgttttccgataaattatctctgccgttgtaaacaccctgacggtcaaggtagtcatattctatatatggcgtaatatcgggcgtcatatggtattgtagaacaaatgcattttccgtcgcccatttcttatggtttgcatagcgataatcgttctgtttgctgtatagcgtcgtttgccatgcgaaggtgaaatcactattaatatggtaagtgacatatccatcccaacgatgaacgttatcacgagacatatcaccggataagtcttgttgtcggtaagctttccagtcgtaacgatagcgaatgccaaaattaagatcttttgtcgcgtcccaggacagttttacgtagggtccgtagcgtgtgccgttgctgctaaaatgcgttaacattcccgggcgcaccgtccattgatcatcaagtttaatcgcgtaattaacttcaacctgaacatcattgagtgcggcattttcctttttattatcatgaatggtattccaggtattactttccatacttgcccaccatccattttgccatccctcactgactttgagtcgagtctcataggcgtggcttccactacgatatccaccacgtacgtccagtgtcgcagcctgagaaattagtggtgacgaaaagcacagtaataatacgccagaaagtattttagcctttttcatatatttcactcatttgtaggatacagaaagcaatacaaagcccgcataaacaattagcatttatgttgtgtaatattttttgccaggcttatagtgtctttggcaacgagtagctgtatttttatattttttgtataaggtctcctgtgaaaattctctttccacattatttaaataaacagagaaccagattaaatacctgagtataaaatctcttctgatgtttaattgatttgaatgttcgtaagctatatcacttactcaatccattttacccagagtcataaaatagagtgtctgttaatctcattttcatattcctttcagactgaagtgcgttttcatcacccgatgagaaagaactgaagtgatgtttgccatagattgcgagatgccctgtctcattgactgtcgcggtgcacctttatacctgttataccagatcaaaaatcacgcaatccatacaacaaaacgagatttgcaattcgtgtcacaaaatatgtcgatctttttctaagaggaagatgccatgtgaagccagacgaacacttgaggtggtcttcaaaaactaaaggcattcttttaactatttgttttataaatgatttatttagggtctaaacaagggaagctttgcaagctaactcagtgagcgtggtgaaaataagtgtttacccgccatcaggctgatcataattctcatcatgaaatatgtttcctggtttttggcttgtaagtggtcacccctgaagtcgatctggaaaggcttgtagatgttggtgttttcaggatgatgtttcagataggttgtttgccgtatcgcccggcgaatagctgtgattgaggaaggtttaagtcgcagtgaccaaagccatatttaccaacgaatgtagatgaaaaagcgtctcctgcgttcccccatatctccaggaaatacacagtctgaaaaaggaatgtaacaatctcatggcgtaagctgacgaaccaggcaggaataatcgctagggacctaagcattagcatgataatagccactaagaaattactgcgttccatgaaatagccattttgtggcaaatgcagttgactaataatgtcatatgtgagacggatagttgaacaaatattaaattttgctgaattttttatgttgattttacttgttacagaacatatcacatgatatatagataagattagttgcattaatgatgagggttattattcgattcgtatcagattgataaatatataaaggtacatagcatgcaagagcatggcgtttgtatggcaaagttattataagtaactatcgctactccatttaagttcactcagaagaactggtccacttacgttagttattaagaaaacgttcgcttttataaacataatcaggattaaaatgttggattattgctaacccagcacagctagtgcgcgtctgtaattataagggaaaacgatgaagaataaggctgataacaaaaaaaggaacttcctgacccatagtgaaatcgaatcactccttaaagctgcaaataccgggcctcatgctgcacgtaattattgtctgacattactttgttttattcatggtttccgggcgagtgaaatttgccgattgaggatttcggatattgatcttaaggcaaagtgtatatatatccatcgattaaaaaaaggcttttcaacaacgcacccgctattgaacaaagaaattcaggctttaaaaaactggttgagtatccgtacttcttatccgcatgctgagagcgagtgggtatttttatcacgtaaggggaatccactttctcggcaacagttttaccatattatctcgacttccggtggtaatgccgggttgtcactggagattcatccgcacatgttacgccattcgtgtggttttgctttggcgaatatgggaatagatacgcgacttatccaggattatcttggacatcgcaatattcgtcatactgtctggtataccgccagcaatgcagggcgtttttacggcatctgggatagagccagaggacgacagcgtcacgctgttttatagagatagttgagataccagggatggtgttaaaaactacattattcttacgatatatcaaaaatgattaaccatttattaattgatgttattgtaagtatgattcttaattataataataaacattaagttaaccatatccatacaaaatacaatggtttatgttcttcaaaataaataaacaaaatcattcataaatttacacatcacttaaattcgcctgtttccatacttttttctttattttttaagcaactggaagttaatccactgcaatctattgttatattgaatcaaatcaatgaaaatagatgttgtcacatcagtgatattttatttttgtatgatatttaatgtaattgactgatagccacatcacttcgggtgtggttatctttttatctattgggctaattttgaccgattgaggtttcctataggtattcattcaaatatatctcagtcaggagtactactattgtgagtaaacgtcgttatcttaccggtaaagaagttcaggccatgatgcaggcggtgtgttacggggcaacgggagccagagattattgtcttattctgttggcatatcggcatgggatgcgtattagtgaactgcttgatctgcattatcaggatcttgaccttaatgaaggtcgaataaatattcgccgactgaagaacggattttctaccgttcacccgttacgttttgatgagcgtgaagccgtggaacgctggacccaggaacgtgctaactggaaaggcgctgaccggaccgacgctatatttatttctcgccgtgggagtcggctttctcgccagcaggcctatcgcattattcgcgatgccggtattgaagctggaaccgtaacgcagactcatcctcatatgttaaggcatgcttgtggttatgaactggctgagcgtggtgcagatacccgtttaattcaggattatctcgggcatcgaaatattcgccatactgtgcgttataccgccagtaatgctgctcgttttgccggattatgggaaagaaataatctcataaacgaaaaattaaaaagagaagaagcttgatttaactaattgataataaagttaaaaaacaaataaatacaagacaattggggccaaactgtctatatcataaataagttacgtattttttctcaagcataaaaatattaaaaaacgacaaaaagcatctaactgtttgatatataaattatttctcttgtaaattaatttcacatcacctccgctatatgtaaagctaacgtttctgtagctcgacgcaacttcctcattcttctctccaaaaaccacctcatgcaatataaaaaactgcaaataaagataactatagaacattaagccaacaaataaactgaaaaagtttgtgcgcgatgctttcctctatgagtcaaaatggccccaaatgtttcatcttttgggggaaaactgtgcagtgttggcagtcaaactcgttgacaaaacaaagtgtacagaacgactgcccatgtcgatttagaaatagtttttttaaaggaaagcagcatgaaaattaaaactctggcaattgttgttctgtcggctctgtccctgagttctacagcggctctggctgatactacacccacgacggtaaatggtgggaccgttcactttaaaggggaagttgttaacgccgcttgcgcagttgatgcaggctctgttgatcaaaccgttcagttaggacaggttcgtaccgccactttgaagcaggctggagcaaccagctctgctgtcggttttaacattcagctgaatgattgcgataccactgttgccacaaaagccgctgttgccttcttggggacggcgattgacagtactcatcctaaagtcctggctctacagagttcagctgcgggtagcgcaacaaacgttggcgtgcagattctggacagaacaggtaatgagctgacgctggacggtgcgacatttagtgcagaaacaaccctgaataacggtactaacaccattccgttccaggcgcgttattttgcaaccggtgctgcaaccccaggtgctgctaatgcggatgcgaccttcaaggttcagtatcaataacctacccaggttcagggacgtcattacgggcagggatgcccacccttgtgcgataaaaataacgatgaaaaggaagagattatttctgttagcgtcgttgctgccaatgtttgctctggccggaaataaatggaataccacgctgcccggcggaaatatgcaatttcagggtgtcattattgcggaagcttgccggattgaagccggtgataaacaaatgacggtcaatatggggcaaatcagcagtaaccggtttcatgcggtaggggaagatagctcaccggtgccttttgttattcatttacgggaatgtagcacggtggtgagtgaacgtgtgggtgtggcgtttcacggtgtcgcggatggtaaaaatccggatgtgctttccgtgggagaggggccagggatagccaccaatattggcgtagcgttgtttgatgatgaaggaaacctcgtaccgattaaccgtcctccagcaaactggaaacggctttactcaggctctacttcgctacatttcatcgccaaatatcgtgctaccgggcgtcgggttactggcggcatcgccaatgcccaggcctggttctctttaacctatcagtaattgttcagcagataatgtgataacaggaacaggacagtgagtaataaaaacgtcaatgtaaggaaatcgcaggaaataacattctgcttgctggcaggtatcctgatgttcatggcaatggtggttgccggacgcgctgaagcgggagtggccttaggtgcgactcgcgtaatttatccggcagggcaaaaacaagtgcaacttgccgtgacaaataatgatgaaaatagcacctatttaattcaatcatgggtagaaaatgccgatggtgtaaaggatggccgttttatcgtgacgccacctctgtttgcgatgaagggaaaaaaagagaataccttgcgtattcttgatgcaacaaataaccaattgccacaggatcgggaaagtttattctggatgaatgttaaagcgattccgtcaatggataaatcaaaattgactgagaatacgctacagctcgcaattatcagccgcattaaactgtactatcgtccggctaaattagcgttgccacccgatcaggccgcagaaaaattaagatttcgtcgtagcgcgaattctctgacgctgattaacccgacaccctattacctgacggtaacagagttgaatgccggaactcgggttcttgaaaatgcattggtgcctccaatgggcgaaagcgcggttaaattgccttctgatgcaggaagcaatattacttaccgaacaataaatgattatggcgcacttacccccaaaatgacgggcgtaatggaataacgcagggggattttttcgcctgaataaaaagaattgactgccgggtgatttaaaccggaggaataatgtcatatctgaatttaagactttaccagcgaaacacacaatgcttgcatattcgtaagcatcgtttggctggtttttttgtccggctctttgttgcctgtgcttttgccgcacaggcacctttgtcatctgccgaactctattttaacccgcgttttttagcggatgatccccaggctgtggctgatttatcgcgttttgaaaatgggcaagaattaccgccagggacgtatcgtgttgatatctatttgaataatggttatatggcaacgcgtgatgtcacatttaatacgggcgacagcgaacaagggattgttccctgcctgacacgcgcgcaactcgccagtatggggctgaatacggcttctgtctccggtatgaatctgctggcggatgatgcctgcgtgccattaacctcaatgatccatgacgctactgcgcaactggatgtgggtcagcagcgactcaacctgacgatccctcaggcatttatgagtaatcgcgcgcgtggttatattcctcctgagttatgggatcccggtattaatgccggattgctcaattataatttcagcggaaatagtgtacagaatcgaattgggggtaacagccattatgcatatttaaacctacagagtgggttaaatatcggtgcgtggcgtttacgcgacaataccacctggagttataacagtagcgacagttcatcaggtagcaaaaataaatggcagcatatcaatacctggcttgagcgagacataattccgttacgttcccggctgacgctgggtgatggttatactcagggcgatattttcgatggtattaactttcgcggcgcacaattggcctcagatgacaatatgttacccgatagccaaagaggatttgccccggtgatccacggtattgctcgtggtactgcacaggtcactattaaacaaaatgggtatgacatttataatagtacggtgccaccggggccttttaccatcaacgatatctatgccgcaggtaatagtggtgacttgcaggtaacgattaaagaggctgacggcagtacgcagatttttaccgtaccctattcgtcagtcccgcttttgcagcgtgaagggcatacacgttattccattacggcaggagaataccgtagtggaaatgcgcaacaggaaaaaccccgctttttccagagtacattactccacggccttccggctggctggacgatatatggtggaacgcaactggcggatcgttatcgtgcgtttaatttcggtatcgggaaaaatatgggggcactgggcgctctgtctgtggatatgacgcaggctaattccacacttcccgatgacagtcagcatgacggacaatcggtgcgttttctttataacaaatcgctcaatgagtcaggtacgaatattcagttagtgggttaccgttattcgaccagtgggtattttaatttcgctgatacaacatacagtcgaatgaatggctacaacatcgaaacacaggatggagttattcaggttaagccgaaattcaccgactattacaatctcgcttataacaaacgcgggaaattacaactcaccgttactcagcaactcgggcgcacatcaacactgtatttgagtggtagccatcaaacttattggggaacgagtaatgtcgatgagcaattccaggctggattaaatactgcgttcgaagatattaactggacgctcagctatagcctgacgaaaaacgcctggcaaaaaggacgggatcagatgttagctcttaacgtcaatatacctttcagccattggctgcgttctgacagtaaatctcagtggcgacatgccagtgccagctacagcatgtcacacgatctcaacggtcggatgaccaatctggccggtgtatacggtacgttgctggaagacaacaacctcagctatagcgtgcaaaccggttatgccgggggaggcgatggaaatagcggaagtacaggctacgccacgctgaattatcgcggtggttacggcaatgccaatatcggttacagccatagcgatgatattaagcagctctattacggagtcagcggtggggtactggctcatgccaatggcgtaacgctggggcagccgttaaacgatacggtggtgcttgttaaagcgcctggcgcaaaagatgcaaaagtcgaaaaccagacaggagtgcgtaccgactggcggggttatgccgtgctgccttatgccactgaatatcgggaaaacagagtggcgctggataccaataccctggctgataacgtcgatttagataatgcggtcgctaacgttgttcccacccgtggggcgatcgtgcgagcagagtttaaagcgcgcgttgggataaaactgctcatgacgctaacccacaataataagccgctgccgtttggggcgatggtgacatcagagagtagccagagtagcggcattgttgcggataatggtcaggtttacctcagcggaatgcctttagcgggaaaagtgcaggtgaaatggggagaagaggaaaatgctcactgtgtcgccaattatcaactgccaccagagagtcagcagcagttattaacccagctatcagctgaatgtcgttaagggggcgtgatgagaaacaaacctttttatcttctttgcgcttttttgtggctggcggtaagtcacgctttggctgcggatagcacgattactatccgcggctatgtcagagataatggctgtagtgtggccgctgaatcaaccaattttactgttgatctgatggaaaacgcggcgaagcaatttaacaacattggcgcgacgactcctgttgttccatttcgtattttgctgtcaccctgtggtaacgccgtttctgccgtaaaggttgggtttaccggcgttgcagatagccacaatgccaacctgcttgcacttgaaaatacggtgtcagcggctgcgggactgggaatacagcttctgaatgagcagcaaaatgagataccccttaatgccccatcgtccgcgatttcgtggacgaccctgacgccgggtaaaccaaatacgttgaatttttacgcccggctaatggcgacacaggtgcctgtcactgcggggcatattaatgccacggctaccttcactcttgaatatcagtaactggagatgctcatgaaatggtgcaaacgtgggtatttattggcggcaatgttggcgttcgcaagtgcgacgatacaggcagccgatgtcaccatcacggtgaacggtaaggtcgtcgccaaaccgtgcacagtttccaccaccaatgccacggtagatctcggcgatctttattctttcagtcttatgtctgccggggcggcatcggcctggcatgatgttgcgcttgagttgactaattgtccggtgggaacgtcgagggtcactgccagcttcagcggggcagccgacagtaccggatattataaaaatcaggggaccgcgcaaaacatccagttagagctacaggatgacagtggcaacacattgaatactggcgcaaccaaaacagttcaggtggatgattcctcacaatcagcgcacttcccgttacaggtcagagcattgaccgtaaatggtggagccactcagggaaccattcaggcagtgattagcatcacctatacctacagctgaacccaaagagatgattgtaatgaaacgagttattaccctgtttgctgtactgctgatgggctggtcggtaaatgcctggtcattcgcctgtaaaaccgccaatggtaccgcaatccctattggcggtggcagcgccaatgtttatgtaaaccttgcgcctgccgtgaatgtggggcaaaacctggtcgtagatctttcgacgcaaatcttttgccataacgattacccagaaaccattacagactatgtcacactgcaacgaggtgcggcttatggcggcgtgttatctagtttttccgggaccgtaaaatataatggcagtagctatcctttccctactaccagcgaaacgccgcgggttgtttataattcgagaacggataagccgtggccggtggcgctttatttgacgccggtgagcagtgcggggggagtggcgattaaagctggctcattaattgccgtgcttattttgcgacagaccaacaactataacagcgatgatttccagtttgtgtggaatatttacgccaataatgatgtggtggtgcccactggcggctgcgatgtttctgctcgtgatgtcaccgttactctgccggactaccctggttcagtgccgattcctcttaccgtttattgtgcgaaaagccaaaacctggggtattacctctccggcacaaccgcagatgcgggcaactcgattttcaccaataccgcgtcgttttcacccgcgcagggcgtcggcgtacagttgacgcgcaacggtacgattattccagcgaataacacggtatcgttaggagcagtagggacttcggcggtaagtctgggattaacggcaaattacgcacgtaccggagggcaggtgactgcagggaatgtgcaatcgattattggcgtgacttttgtttatcaataaagaaatcacagggcattgctaatgcaggtacgcaatattacctgaagctaaaacctgcacgttagccctttgtaggccagataagacgcgtcagcgtcgcatctggcataaacaaagcgcactttaccgacaatccgaacagagcctgccaatggcaggctcaggtgctcttttacgctaccatgctaataatcagcacaataatcagcccaaccacggagttgaccagctccagcagaccccaggttttcaacgtgtcttttactgacaggtcaaagtaatctaagaggcattgctaatgtagggaatgtgtctgaacctgcggtcattgtcagtaccagcatcaggccaatgccgaataccacccagagaatgttaagcacatgcataacgttttaccttacctggttgaaccgttgttattttgggcgacatgttatgtaaattggtcaaccattgttgcgatgaatgtcacatcctctgatcaataaccatcgattaccctttgctgcaatttgcagcaacaaccaggagagtgaaattcttgtgatgtggttaaccaattttagaattcgggttgacatgtcttaccaaaaggtagaacttatacgccatctcatccgatgcaacgccatggctgcggtctggttgttcatccggatacctaaacaactccggggctccacgtctctttgctgtggaacccactatgtgaaagaggaaaaatcatggaacagacctggcgctggtacggcccaaacgatccggtttctttagctgatgtccgtcaggcgggcgcaactggcgtggttaccgcgctgcaccatatcccgaacggcgaagtatggtccgtagaagagatcctcaaacgcaaggcgatcgttgaagacgcaggcctggtgtggtctgtcgttgaaagcgtaccaattcacgaagatatcaaaacccacactggcaactatgagcagtggattgctaactatcagcagaccctgcgcaacctggcgcagtgcggcattcgcaccgtgtgctacaacttcatgccggtgctcgactggacccgtactgacctcgaatacgtgctgccagacggctccaaagctctgcgcttcgaccagatcgaattcgctgcattcgaaatgcatatcctgaagcgtccaggcgcggaagcggattacaccgaagaagaaattgctcaggccgctgaacgcttcgccactatgagcgacgaagacaaagcgcgtctgacccgtaacatcattgccggtctgccaggtgcggaagaagggtataccctcgaccagttccgtaagcacctggagctatacaaagatatcgacaaagccaaactgcgcgaaaacttcgccgtcttcctgaaagcgattattccggttgccgaagaagttggcgtccgtatggcggttcacccggacgatccgccgcggccgatcctcggcctgccgcgcattgtttccaccattgaagatatgcagtggatggttgataccgtaaacagcatggcgaacggtttcaccatgtgcaccggttcctacggcgtgcgtgctgacaacgatctggttgatatgatcaagcagttcggtccgcgtatttacttcacccatctgcgctccaccatgcgtgaagataacccgaaaaccttccacgaagcggcgcacctgaacggtgacgttgatatgtacgaagtggtgaaagcgattgttgaagaagaacaccgtcgtaaagcggaaggcaaagaagacctgatcccgatgcgtccggaccacggtcatcagatgctggacgacctgaagaagaaaaccaatcctggttactccgcaattggtcgtctgaaaggcctggccgaagttcgcggtgtcgaactggcgatccagcgcgctttctttagccgttaatacccaccggcatggctgcgcgccgtgccggttccttcttccttgccgtcactctctgaagacggattctggagtttacgatgactactattgttgacagcaatctgccggttgcccgcccgtcatgggatcattctcgtctggaatcacgcattgtgcatctcggttgcggggcgtttcaccgcgcgcaccaggcgctgtatacccatcatctgctggaaagtaccgacagcgactggggtatctgcgaagttaacctgatgccaggcaacgaccgcgtgctgatcgaaaacctgaaaaaacagcaactgctgtacaccgtggcggaaaaaggcgcggaaagcaccgagctgaaaattatcggttcgatgaaagaagcgctgcatccggaaatcgacggttgcgaaggtattctcaacgcgatggcgcgtccgcagacggcgattgtctctctgacggtcacggaaaaaggctactgcgctgatgcggcaagcggtcagctggatctcaataacccgctgatcaagcacgatctcgaaaacccgactgcgccgaagtccgcgattggttacatcgtagaagccctgcgtctgcgtcgtgaaaaagggctgaaagcatttacggtgatgtcctgcgacaacgtgcgtgaaaacggtcatgtggcgaaggttgccgttcttgggctggctctggcgcgtgacccgcaactggcggcatggattgaagaaaacgtcacctttccgtgcaccatggttgaccgcatcgttccggcggcgacgccagaaaccttacaggaaattgctgaccagctgggtgtttacgacccgtgcgccattgcctgcgaaccgttccgtcagtgggtaattgaagataacttcgttaatggtcgtccggactgggataaagtcggcgcgcagtttgttgcggatgttgtaccgttcgaaatgatgaagctgcgtatgctgaacggtagccactctttcctggcgtacctcggttacctcggcggctatgaaactattgccgacaccatgactaacccggcttatcgcaaagcggcctttgccctgatgatgcaggaacaagcgccaacgctgtcgatgccggaaggtacggacctgaacgcctatgcgacgctgctgatcgagcgtttcagcaacccgtctctgcgtcaccgtacctggcagattgcaatggacggcagccagaagttaccgcagcgtctgctggacccggtgcgtctgcacctgcaaaacggcggtagctggcgtcacctggcgctgggcgtggcgggctggatgcgttacacccagggcgtggatgagcagggtaatgccattgacgtggttgacccgatgatggcggagttccagaagatcaacgcgcagtatcagggtgcagaccgcgtgaaagcactgctgggcctgagcggtatctttgccgatgatctgccgcaaaacgccgactttgttggcgcggtgacggcggcatatcagcagctgtgtgagcgcggtgcgcgcgagtgtgtggctgcgctgtaactaactgattaccctacagacttactggtcaatcaaactaatatttggttgaccagttttcgtttttttgcccacctgtacgtgccaacatccagtgctaatggtatagtttgagcttaacgggtgccgtaaaattgcccgttgtaggtcggataaggcgttcacgccgcatccggaaaaaatttgattaaccgcacctaacggacacaacaccatgaaatctgccacctctgcgcaaagaccttaccaggaagtcggggcgatgatccgcgatctgatcataaagacgccgtacaatcctggcgaacggctgccaccggagcgtgaaattgcagaaatgcttgatgtcacgcggacggtggtacgtgaagcgctgatcatgctggagatcaaagggctggtggaagtgcgtcggggtgcaggtatctatgttcttgatagctcaggcagccacaacgcagacagtccggatgccaacgtctgcaacgatgccggtccttttgagctgttacaggcgcggcagttactggaaagtaacatcgccgagtttgccgccctgcaggctacccgcgaagatatcgtcaaaatgcgcaaggcattgcaactggaagagcgtgaactggcttccagcgcgccgggcagcagcgaaagcggtgacatgcagttccatctcgccattgccgaagcaacgcataacagcatgctggtggagttattccgtcagtcctggcagtggcgggaaaacaatccaatgtggatccagttgcacagccatctggatgacagcctgtatcgcaaagagtggttgggcgatcacaaacagatcctcgccgcgttaatcaaaaaagatgcccgagcggcgaagctggcaatgtggcagcatctggagaatgtgaagcagcgcttgctggagttctctaatgttgatgacatctatttcgatggctatctgtttgattcatggccgctggataaagtcgacgcctgatccctcatttctggtgcaaagttgaaccgctttgcactatgtatgttccctgaatagttaattatgttctgcagaatatattatgcgtaatttaatcattacgtacgatatattgttttggaataattatatatcagtttaacgctgagaaattattcggaataatcagaatatgttaacgtatttccgttatgtttaatgacttttgtcaaatgatacctttttaaattaaaagtcagtggatattcttttctgtacagtgttttatctttggcggatcttataaatcccttatgaaagtgccagggacgcaatgagcataaaggaatgattatggaatatgagcatcaacccagtggtgtccggcagccagggcaggatacagatgccactaaacgtcaggagtgcgcaaaatgatgcgccaatcagttcagacggtattacctgaaagtacaggaaacaatacgttatcgctgcgtgattccgtatgccgggatctctttcaactttttagttctccccattcaccgctaccaatattacttgtttcaggcatgcctgagtggcaagggcataatcagagcgacaagcttctccagagttggtattgccgccagttacgctccgcgcttttatttcatgagccacgtattgcggcattgcaggtcaatctgaaagaagcctattgccacgagttggccattagtctggagatgatgctgtaccacgatgatgagccgctaacgtttgacctggtctggcagaaggggaactggcatcgcacgatgccgcagtaaatgacgggaaacgcgatacgcgcaagacgtatcgcgttaggtcacaattagtgggaggctctgattgctgctttcaaggccggaagccgggacgggctggcactgagcttatcaatccccatggtgagcagtcgtgctgtttgctgggtatctccagccatttcaccgcacatactgaccggaatttcattattacgtccggcctgacacaccatagcaatagcgttaatcaccgcgtcattacgataatcgaccagtttcgcgacggtgctatttcctctgtctgccgccataatatattgcgtcagatcgttggtgccgatggaaaagaaatcgacttcactggctaatttttctgcaatcatgactgcagcaggaacctcaatcataattcccagcgccggaagattttctgcagtaagtcccagcagttttgcctgcgtttgtatcagcgttttgacggcgttgacctcctcgagcgttgaaaccatcggcagcataatttgcaacgttgggtattctttcccggcccggagaagtgcgcgtaattgcggaataaatatttgcggatgcgccaggcacaaccggataccgcgaagtcccaggaacgggttgtcctctgcgggtaaagggtacgaaggtaatggcttgtcaccgccaatatccagagtgcggatggtgactggtttatcgccaaaagcctgagcaacagaacaatacacgcgaaactgctcttcttcatcgggtaatgttgcagactcatggaataaaaactctgtgcgcagtaaacccacgccctcagccccgtgagatagcgcagcctcaatatcttgcaggtcaccaatattcgccagcacgctgatttttcgcccaccttgcgtgacagcgggcagcatggcatcagctaactgacgatccctttgttgccgccatgcttcggcgcgttgcagtaaatctaggcgggtgacctcatccggctgtagccacaaacggcctgtttcaccatcaagaatgaccgtgtcgttatcgcggacgttttgcggggtaatagctgccttcacaatggcaggaatacccattgctctggcaaggatcgctgtatgtgaagttgttccgccattatgaagacaaatgccaagaatgtgtgctttattcaggctggttatctgtgatggcaacagatcgttggctaacaaaatgcagggcgcggtagtgataaagtgttgttcacttaccccgcaaagctggttcagtacctgacgtgtaaggtcacggatatctgcctcgcgttcacgtaaatacagtgtttccgcctgacaatattgctctgctaatgcctgcatgacttctaaccatgcgaattccgcctgtttgccctttgccagacgttgctgtaattgccggttaatctctggatcttcaagcatcattttatgggcggcaaaaatatcgccttcagggcctgccgctttatcggcaagttcacaaacaacaatgtcgatagcagactcgattcgcgacagctcttcttgcggagaatcgacggtgcgctgcgtaatttctggtcgttcgcaggtaaaccatttaacaggaccaatagcgataccattttgtactgacaagcctgatattgcgccatcgacaggggcgctgaccaccggcgtttccgttagcggaatctctgaagaagcgagcaggtgagcttcaccaaaatgatttttcgccaacgtttcaattgccttgagagcgtcactggcatcggtgccttcggcctggaagatgatttcatcgccacagcggacgcccagcattgccagttcgttgagactgcgggtgctggcgcgtttatcgcctttgatgacgataatgtttgccgaatattgtgctgatactttcaggatgctggctgccggacgagcatgaatgccgtggggattacgtatcgtccagcaaaaagtttgccattcatcgcaatgattgactggtgatattactggaataacctcgcctgcagttgaggatggcgtgagttgctgctgtttagcacacagagcaagatccacttcagcgataatctccgtcaccgaaagccccgctgcggcagacgttaccgctgacatggcacctttcactacaggggcggcgagcagataaattgcacttctttgctcttcagaaagcagctccagcgccatctcggtactaagcagcgcactgcccatatccatgagtaccagaacgccatccggtgaccagaccgattcaatcgcagacataatggcaatagcatcagtgccaatcggattttgcggatcatcaatacctgcagcaatggccagaggaacgtcccctccagacatctgtagtgctaattcctcaaccccctgggcgagacgtagactatgagaaacaataacaatggcaaccataatttatcccgcgaatccttcctgcatagccttaatcatcagccaggaggaggtcgcgcctggatcctgatggcccacactgcgagcgccgagataactggcacgtccttttttcgcctgcatattgatggtgttatcgacggctgttgccgcatcttgcaccatcgtattcagcagaagggaaggcgacattccggcttgcaggttctttttggcttcgtggagaactggaacccagacatcacacagtgttttatccccttgttctgcttttcctcgtgcgataacgcctgcaatcccttcttccagacacgccagccactcttccagagttaattctgttctggctcccactgccgcagaagcgcgaataaataatgtgccgtaaagaggaccactggcaccgccaacgctggaaagtagtttcatgccagtatttttaaggatattgccaatatgctgacgttcaatgtcgggcaacgtcgctttcacggcactgaaaccacgattcatattgaggccgtggtcggcatcaccaatatctctgtcaagtgcggttagaaaatcttgttgttcagtaagatgtgcagcacaactctccagccaggcaataacatgtttgttttgaattttcatataatgtccttattaacatccccaacgaagcgctggcgtattgaccggggcatcccaaagttgcaaaaactctggggtacatttcagcaggctaatggaaaatccggccatatctaatgatgtacaataattaccgaccaactggcggctaattttaattccctggcgctgtgcggcgcacataaataccctggctacaccatataactctgattcaggcgtgctgccaagtccgttaattaacacaatatattcggcattttgatcgaatgactcattcattgatgatgcgtcaatccatccccccgcatggcgatcccaatggcgtaatgtgcgtcgccagggggtattatccagtaattgcgctatcacgctgtcgattaaagtgttcagatcttgcaaagtgcggcgttcaatgccgggttcaccgtggatcccgacaccaaattcgatttcattatcagccagttcaaatgagggttttcccgcggcgggaaccgtacaggctgacagtgcgatgccaaaagaacgggtggcattgttaacatctttgccaagttgctcgcactgccccaggttatatccctgaagtgcagccgcaccgacaatcttttcaacaaaaactgtacccgcaacaccgcgacgtccggctgtatacaggctatcttttaccgctacatcatcatcaataatgacggtcccaacggcgatgccttcttcgtgtaacatctcgactgccgtttcgaaattcagaatatcgccagtgtaatttttgatgaaaaacagaacgccagaaccattatcaaccgctttggcacattcgatcatttggtctggtgtgggcgatgtgaagatttcaccaggacatgcaccggttaacattcccataccgacaaaacctgcatgcagtggttcatggcctgagccgccgcctgaaatcagcgccactgcattatcggtttgtttgcaccacacatatcggggtgcgtaatttgcctgcaggtgtggccaggtggcgatgagtccttccatttgttctgtgacaacagaatcaatctggttaattaatttcttcatagtcattcctgttctgataaattacgtaaatcgcgctaaatatgcttgcgagattaattctccagccgcaataaaacaaatcgcacgataataagattcataatgaaacagttaattcattgtgttgttccaaaatgaaatgggatcggtgacaagattaggggtttgtgattaaagcataaaaaatatttttattattgctttgggatgatgttttttacagcgcgatcataaaacataatttttcgcgaatgaaatgtttgccgccactggatgcaacgagtaggttaacagtgaagcaaaacaagttacgcaaggaatgatatggataagattattataagtccggctaaatatatccagggaaatggttctctggataatattgctacatatgcggcgagtttgggaacagaaccattaattattgcagatgaatttgtgaccggtctggttggtgacagagtaagccagagctttgcaagagaaaacattattgcggattttgatgttttttgcggtgaatgctcgcaaaatgaaatttctcgaattcgtaagaaatttaatcagcgtaaatataatgtcgttattggtattggcggcggtaaaacgttggatacggcaaaagccgtagcgtattaccaaaaaattccggtggtggtggtgccgacaattgcttccacagatgcgccaaccagttctctggcagtaatttacaccccggatggtcagtttagcgaatatctgtttttcccgaaaaacccggatatggtgattatggatactggcgtcatttcagccgcgccagtgcgtctgctggtggccggtatgggagatgcattgtcaacctggtttgaggcgagagccaatcaggcgtcaggaaaagccacaatggcaggtggggcgtcgacactggcggcactggctattgcccgactctgttataccacgctactggaagatggctataaggcaaaagtcgcggttgaacaaggtgttagcaccaaagcggtagagaatattatcgaagctaatacctatcttagcggcattggatttgaaagtagcggcctggcggcagctcatgccattcataacggcatgacgcaactggaggaatgtcatcattgctaccacggtgaaaaagtggcatttggcgtcctggtacagctcgtactggaaaacgcaccacaggaggaaattgaaaccgtactcaatttctgccatagcgttggcttgccgacaaatcttcatatgttaggcgtgaaggaaattaataaagataaattacgggcagtggctaaagccgcgactgctgaaggggaaactatccataatatgccattcgtagtaacagcgcaggacgttctttgtgcaattttaactgcacatcatttgggactttaaaaaataatacggcctgtgcaaagcaggccgttggtgtcattttaaatacttcattcgggaataaatatgaccagtaactggaaacgttggatcacgctggcgttatgtggtattgccggaagtgcaatatataaattgccttatttacgggaaacctattacgacgcgatgcagcaggctacaggagcgactaatgctgaacttggttttctaatgacagcctatggtctggtgaactttttattatatctacctggcggttgggctgccgatagattttctgcacgtaaattaatgaccttttcattaatttccaccgggataagcggtttttattatgcgaccttcccctcgtatactatgatctgtttgttacatgcactttgggctgttacaaccgtatttacgttttgggccgtgtgtgtgcgaattattcgtaccctgggaaccagcgaagaacaaggacgcttatacggttactggtttctgggtaagggattaacctccattgtactgggatttctttccgtgccggtatttgccaaatttggcgaaggtgttgatggtttacgggcgacaattattttttattccgtagtgactattctggccggtgttttagcctggtttgtttgtcaggatgaaacgcacagcgaagataaagcgaatttccgtctggcagatatggcattcgtgctgaaaatgccgacggtttggctggcaggtgttgtgaccttttgtatgtggtcaatttatatcggctttggcatggtcacgccgtatctcacgcagatcctgcatatgggcgaatcggaagtggcagttgccagtattcttcgcgcctatgtgttatttgcgatggggggattaattggcggacaactggccgaccgctgtgcgtcacgcacgcgttttatgatttacgcctttatcggcatgattgtctttactaccgtttatttcttcctgcccggtgagtcgcgctacgtcactattgcgctggcgaatatggttgcgttgggcgtgtttatttactctgcgaatgccgtgttcttctcaattattgatgaggttcggatcccggcaaaagtcacagggactgctgcgggtctgatctctttactgacctatttcccggaaatctactgctacacgatggtgggcaatatggtcgaccgcaaaccgggtattgccggttatcaggatgttttcctgttcatgttggtttgcgcattcatcggccttatcgccgcactggtcctccagcgtgtgaatcgtaaaagtaaaaatcaagtcaatgaaatcactcaaaacaatgcggattgcgcatcctgaatctgacgggggaaccaatggtggacatgattaatgaaagtgcacggcaaacgccagtcattgcacaaacggacgttctggttatcgggggcggtccggcaggattatccgctgccattgcggcagggcggttaggtgccagaaccatgattgttgagcgctacgggtcgctaggcggcgtattgacgcaggtcggggtagaaagttttgcctggtatcgtcatccggggacggaagattgtgaagggatctgtcgtgagtatgaaggccgcgcacgagcgctgggtttcacacgaccagaacctcagtcaattagcgaagttatagatactgaaggatttaaagttgtcgccgatcagatgattacggaatctggcgttgagccgttatatcactcctgggttgtggacgtgatcaaggacggggatacgttatgcggtgttatcgtcgagaataaatcaggtcgaggggcaattctggcgaaaagaatcgtcgattgcacgggggatgctgatattgccgctcgtgcaggcgcgccctggacgaaacggagcaaggaccaactgatgggcgtcaccgtgatgttcagttgcgcaggtgttgatgtggcacgctttaaccgttttgttgcggaagaacttaagccgacctacgcggattggggcaaaaactggacgattcaaaccacgggtaaagaagacccgatgtttagcccgtatatggaggatatttttacccgcgcgcaacaggatggtgtgattccaggtgacgcccaggcgattgccggaacctggtcgaccttttctgaaagcggtgaggctttccagatgaatatggtgtacgcctttggttttgactgtaccgatgtcttcgatttaaccaaagctgagattgccggaaggcagcaagcattatgggcaattgacgcactacgccactatgttccgggctttgaaaatgtacggttacgcaattttggtgccacgctggggacgcgtgaatcacggcttattgagggggaaatacgtattgctgatgattacgtccttaatcaggggcgttgttcggacagtgtagggattttcccggaatttattgatggttccggttatctcattttgccaacgaccgggcgtttctttcagatcccttatggttgtctggtgccgcaaaaagtggagaaccttttggtcgccggtcgctgtatttccgcaggcgtagttgcacatacttctatgcgtaacatgatgtgttgtgccgttaccggtgaggccgcaggtactgccgccgtggtttcgctacagcaaaattgcaccgtgcgtcaggttgctatccctgatttgcaaaacacgctgcaacagcagggcgttcgtctggcataacaacaaggcgcagagagctgaaagcctgtctgcgccttgcaggagaaagaccatgagggatgatgacctggagcacttaagtgccaattactggataaccacagttctctgcggcctctttttggggatattcctgttcatgctgcaacagcatcagcgtggtttagctctgtattgtattgcggctctttcacttatttgcgcctttttttctttacgcctttcccgacaattgcaacacatgaaaaaggaacggcgaaatattcgacctcattgaatgaaaacattcaggagactgaaatgcactatttaaaaaaacgcttttctttgattgaactgaatgtgtttatcccagcaatattatttattgcggtaatcattctgtgtttgacgatatatccacaagataccagccggtatataaataaaatacatcattttttaacctgggaaatgggcgggatttttctggtcatgacttttctggttgtactttgttgtctgtggctggccttctcacgttatggcgatatcttgttaggtcagtcgggagaaaaacctgacttcagcttgttaacctggcttggacttatttttacttctggaacggggggcagcttgttatatctggcctctgtagagtggatttggatcattcagcaaccgccttttggcgcaacagcaggaagcgctcaggctgctcgttgggcctctgtttatggcatgttccattgggggccgtccgcatgggcatggtatttgatttgcgccgttcctattggttggtttatgcatgttaagaaaacaaactcattaaaggtcagtgatttatgtcgtggatgtttgggagcgcgtgcggatggtttttgcgggcattgtgtgaattttttctacatgtttggtttgctcggcggcgcggtaacgtctctggcgctgggaacgccgatgatttctgccgtattttgccatgtgttccatctggatcctgccgggcagtttatcaatgtcatggttatttttatctggacgctagtaccattattcattctcttttttggacttaaaaaaggtgtggcatgggccagtaactggaatattcgtgctgacattttgatgctactggcaatactgatttgtggaccaacggcatttatacttaatcaatcaattgatggtctcggcctgatgctgcaaaattttgtagcgatgagtttaagtaccgatgctattggtcgtagcggatttccacagatgtggaccgtattttatttttcatggtgggtcgtgtatgccatcccattcggtttatttatcgcccgtatttcaaaaggaaggacgatccggcaattgattgtatgtggaactctggcaggttcattgggatgcatggttttttacatggtactggctaatttcggcttatcgttgcagacaactcatgtcatcgattttgttcccatacttaacgaacaagggcgaggcgttgtcgtttctcgtttactggagcagctacccgcaagtcaggtgtttttggttgcttttggggctatagcattaatttcatatattaccggacactgtactgtgggttatgccctcggttttgcgacgcaaaaacgggcagatagtgagagtgaaccggcattctggaacgtggcattttggttgattatgactggaatcgtcgccatcacactctatcttcttgatgcgcaaagtctgcaaccgctacaaacggtgtctattctggctggactaccgctttgcggcgtggtgtttattttattgaagagttttttgacgcagcttgcggctgaagagaaaaacgcgagagatgaataatgatgttcaggaatgcccggtaatttgcattatcgggcattttaccgaacgggaattaactcaggatcgcacgaaaatatcccgccagattttctccaagacgaattaaattattttctccctgactcagcgcggtcggtaaattgcaagggccgttgacgacagaaaaacaggcttctattccacactggcgtaactcattcagatcaagttgatcatcgatatacccggcaattgcgataaccggaacgcccatcatctgggcaactttggctgcgcctacgggcgctttgccattcaggctctgactatctaatttcccttcaccgacaatggccaatgctgcgtattttaaatgttgggtatattgaatcgcttccagcacgagcgaaatacccggttgtaagcgagcatcgagaaaagccatcaaggccgcgccaacgccgccagccgccccagaaccgggtatcgtatcgacgtctttaccacaacaacggtagatgcaacgggcatagtttttcattccctgttccagttgctcaaggtcgttagcactggcccctttttgttgagcaaaaacccgggtcgcgccgttatcgccggttagtgggttggtgacatcacaggccgcaataaatttcacatttttcaatcgtggatcgaggtgctgtaagtcaatgtggtgaattgccgccagccccatcccattaacagagactgatagcccttcggcgtctgtaaacgatgcgccaagtgccgacatcaacccaataccgccatcatttgtagcactgccacccaggcatagaataacggtatcaatattgtgttccagggcggcgagaataagttcgccagtgccaaacgacgtcgtataaaggggagaacgctggacaggagaaaccagttccagccctgaagcttgtgccagttctatcactgcggtggtttggttgcctaaaataccgtattgcgcatgtattgattcgccaagcggtccggtgacttttttagtgtaaaacgtaccgtcagtcgcatgaatgagtgtttcgagcgtgccttcgccgccgtcagccacgggcaaacacaccagttggctgccaggcaggaccttgcgccagccggttgccagcgcttcagcgactttccatgcgggaaggcattctttaaaggagtcgggggagataactatcttcatagcaggtctctcaaaataggggaatggggcagggcaatgagtgaacgaagggaaccggtggttcccttaattcattatttacggatagtgaaattggcttgtgtttcaagcgcccgaattaacgcagaatgatcccactctttaccaccgagcgcggcgcaggcgctaaataactgctgtgtcgtcgccgtgttaggaagcggggtattcaacaggcgggcattctccagcgccagattcagatctttttgatgcagactaatacgaaaaccgggttcgaatgttccttttatcatccgttcgccatgaacttccagcacgcgagaggaggcaaaccctcccatcagcgcttcacgtacgcgggcgggatcggcacctgatttactggcaaagagcagggcttcagccaccgcttcaatattcagtgcaacaataatttggttagcgactttgcacgtttgaccatcaccgacgttaccgaccagagtgatatttttacccatcaattccagaatcggtttgatctgcaaataaacctcttcacatccgccaaccataatggaaagcgtcccggctttcgcgccaacttcaccgccagagacgggcgcatcgatatattccgcgcctcccgcgataatacgttgtgcaaatgctttggtggcaaccggggaaattgaactcatatcaatcacaattttcccgtggcttaaaccgtgtattacgccatagttgggatgaaaaagaacatcctcaacatgtggggtatcagggagcatggtgatgatgacctcacactcctgcgcgacttcacgcggtgtagagcaaacaatgccacgttcaccaataaactcttgcggtgcaggttcaaaatgcgctgaaaaataaagagtatgtccggcttgttgtaaattataagccatcggcttacccattatgccggtgccgataaatccaatattcatgataaatacctcagggattaaaattgagtctcgttttttagccagcgtagactttcagtcgttgtcgtagatggaacatattcgcaaccaatccatccctgataaccaatctggtctatataatttaacaaccacgggtaattaatttctcccgtccctggttcatgacgcccagggttatcggctaattgaatatgttcaatgttattcaggttgtttttgattgttgtagcaatattcccttccatgatttgcatatgataaatatcgtattgatagcgaaaatcaggatgatttacatcatgaataatattgagggcttgtctggtgttgttaacaaaaaaccgggaatatcttttgtattaatggcttccagaactaactttatgccatgagaagccaatttatctactgcatagcgcaaattttcgaccagtgtttcatgacattgttcatgcgaataaccacctggatgttttcctgcaaggcaattaacttgtgaacaattaagggcctgggcatattctatcgctctgcaaacaccctcctgaaattcttttgcccgactaggatgacatgcaataccccgttcaccctcttgccagttacccgcaggaagattaaacaaaacctgagtcagattatgttgatgcagttgcgaagccagctcgtcagtggaaaagtcatagggaaaaagatattcaacgccgtggaatcctgcgtgacttgcctgcgcaaaacgttcaataaatggatgctcggtaaaaagcattgataaattcgctgcaaactttgccataatcctgtttccttataaatcgagaatttcttcaaattctgtgactttattaatgtcaggtcccatagcgatattagtcacgcgttcagtaataatttctacaacaacaggtacgtgaaattcgtcacgcaaacgctgggcttcttgcagtgcaggcgcaatatcctgtgatgcgaatacgcgaatcgctttacatcctaatccttcaaccacagctttatgatcaacgccataaccattaatttctggagcattaatattttcaaatgacagttgaacgcaataatcaatatcaaatgcacgttgtgattgacgaatcaaaccaagataagcgttgttaagtaaaatatggatatacggaagattaaattgtgcgccgacggctaattcttcaatcaagaattgaaaatcgtaatcaccggatattgccacaacgggaacagatggatcagcttttaccgcgcccagtgctgcgggcattgtccagcctagcggcccagcctgacaggcattaatccagtggcgtgggcggtaaacatgtaaaaattggtttgcggcgatttgcgccagaccaattgtcgaaatatagcgtgtctccggtccgaaaaccttattcatttcgtgatacacgcgctgcggtttaattggattgcagtcaaagtctgaacgacgaagcattgtgcgtttacgctcggcacattcggcaatccagcgactgcggtctttcagttctccacgtgacttcatatcacgggcgacctgaataaatagcgttaaggcgctttcagcatcagaaacaatgcccagatccggcgcaaatatccggccaatttgtgcaggttcgatatcaacatgaatgaatttgcggccttcggtgtaggtctcaatggctccggtatggcggtttgcccaacggttaccgataccaaaaacaaaatctgaggccagataactggcgttaccatagcgatgacccgcctgacatcccatgcgaccaatcattagggggtgatcgtctgataaagcgccccaaccgcgtaaggtttgaatgacgggaacgccagttaactcgacaaactcacgcaacaattcactcgcttcggcgttaataatgccaccgccagcgatgatgacgggcttttcggcgtcatttagcatttctaatgcgcgtacggcctgggcccgtgttgccttaggttgccaggggattagtggctgatagagatcgatatcaaactcaatttcggtcatctgaacatcaaaagggagatctaaaagaaccgggccagggcggcctgaacgcatttcctagaaggctttctggaatatccccggcaactgacccgcttcgagaattgtgcgagccattttggttactggcgtggcgatagcctcaatatcgacggcctggaaatcttctttatgaagttttcctacgggagcttgaccagtaatgcagagaataggaatggaatccgcagaggcagaatacagcccggtaatcatatcagtgcccgcagggcctgatgtgccaatacacacgccaatattgccattctgactgcgggtgtaaccttcagccatatgcgaggcgccctcaacatgacgggccagaatatgatcaataccgcctgattttttcatcgcggcatagagtgggtttattgctgcgccgggtacaccaaaagcaacgctaatgccttcttttttcagtatttctactgcagcttcgattgcacgcatcctcgccatacattatttctcctgatatttacgctgagttgaatagtcagtcaattttggaatttaacgatgaaatatctttgaggaaataaaagggcagaacaaatttcgctgcactgtttcacagtgaaacaactcgtatgcctgtgttgtttcagtttgaataattataaatatcaaacgcaaagatttcagatgttgttggcagttttaaaatttatctaatgtatcattcgttttttattgctttaacggttattatttctaatgtatgtgtgattacattgttgataaggtctgtttttgtaatgatccaggctagatattattgcgtttgatcaagcttactggcatagcattctgatacaagttctgaaaatgacttgaatggatattattataatgaataaagagtcgtatcataatgatctaaaaaataaatggaaaatgtttgttaagcatggttgggtcgcgacaaattcgactaatcatgtgatgctgaggtcatggcaaaaatgtctcaagcattgtgaccctcgccactggaacacgcctgtcaaagcttccgggcaaacattgcagacgattttttctcgtaacgaagagtttattagaatttcacaaagagttgttgaagaccatttcaccctggctggtgacgaccggttggcatttttgatcattgatccacacggctgggttctatcgttgaatgcagcaggcgattattccagtcaattgcgagagttaggaattgaatctggtatgtcatgggccgaagatggcattggaaccaatgtatatagtctttgtcgggaaacaaatttatatacacaactggaaggagcagaacattttagtgaacagctacattgttatgcgatgagcgctgctccggtcattgattattatggtaatatacatggatacattgtatgtataattgaaaccaccgccgagcttgttaaattaaaaacatcatattcatgtgcaacagaaatcgctaattatatctatattgagaatgaacaaaagttaataaacaaagtactttgccagcataatgctgtgattgaatgtatggatgacggttttatttgttggaatagtcattctttaattacgatggttaattctcaagcacaaacattactgaatattgataaagaaagtttaattggtcagaacatccgaaaaggattcgtatttccgccgattttgaatgaggcaattacacaacgaaacaaactatcgcaaaagcaaattgtcctcgaatgccgtggcgaatttattgaacttatggttacccttcgcccgttaagcgatggttcgtttttgctttttcttcatccattagacaaaatcaggaaaatagcccaacagcaaataagcactaatgcaaattttacctttgacagtttacatgcggcttcaggtggtatgaagcaggtattacttatcgctcgccgggcaattaaatccatctctccgattttgatcaatggcgaagaaggtgtgggaaaattgagtttggcgatggcaatacataatgagagcgagcaacgtgatgggccatttatttctgtagattgtcagatgctatcaccagaaaatatcttacacgaacttcttggctctgatgttggcccttcgccatcgaaatttgaactggctcataatggcaccttatatctggataaagtcgaatatctatcaggggaagttcagagtgttttattgaaagtattgaaaacggggcttgttactcgctcagacagccatcgtttgatccccgtacgctttcgtctgattacatgtaccagtagttctttacgtgagtacgtgcaacaaggggcttttagccgacagctatattatgagatctccatgaatgaaattgaaattccgccattgcgcaaacgtcgtgaagatctcaagcaaatgattgacgatattattgataagtatcaggagcgcacgcgaaaaaaaatgacaatcacgcctgacgcaaattcagttctgcttgagtaccgttggcctgggaacatctccgagttcaaaaatcgaatggagaaggtatttattaactgcaatcgacttgtactcgggttagagaatattcctctggatatccgacaaaataacagtagtggcgacgatgatatccctcatcttacttcactggcagaattggagatgcaagctattgagcatacatgtcgtgtctgcgaatggaatctaactaaagcagctgaagtattaaaaattggtcgtacaacattatggcgcaaacttaagatctataatctctatccaaatgttgagcatgcagattgatgcttttcaaattgaaagaattttaatatcgcagtgtttcattttgatgcagtgctttaatggtattgaaatattgtgatgtgctccataaatgccaatgtggttattagccagggagacggaaaatgtgtttacactcctgaaataataaaaaacaggcaaagagagatgatctccttgtatgtctgtattagcatgatgttgcttgttaataattaaaaatatcaacgcgcttatataagcgcgggggattgttttactcaattattgaatacggagataaagtatggaattttatctggaacccgctcgtaatatacctgtactggcaaccacggaagtgttagttgttggtggtggtccatcgggtattgccgcagcaatgagtgccgctcgtgaaggcgcagctactatgctgattgaacgtttcggttgttttggcggaatgatgacaacggctggcgtcgagtcaattgcctggtggcgtcatgaaaatacggtagagtcaggtggactggcacgcgaaatagaagaaacggcaaaatcaatgggggcgtccagccctgagccgcaatcgaatagtcaggctattaacgccgagcgtttcaaactggttgcggatgcaatgcttgaacaggcaggtgtgcgccgcgtactacacattaccgccgttgatgttatcaagcagggcaataatttactcggcgtaataacagagagtaaatctggtcgtcaggctattttggcaaatgtcattattgactgtactggtgatgctgatattgcatggtttgccggagcaccatttattaagcgtgaacgcgaagagctaatgtgtatgacaaccgtttttagttgcgcaaatataaataaaaacgcgttcatgcaaaatattaatagcacggaacctaaatatggagactggggggcggatgaagaaaataaaaactggtcttatgatgttcatgaatcttgtcgcgatatgtttagcccttatctgggtaaagtctttgcgaaaggaaagtcggcaggaattattccaaaagatgtgacgttaggcggttcctggagtacggtcaccgagtatggtgatgcgaattacttgaacgttgtcagcatccctgccgtcgattgtacggatgtttttgacctgacgcgtgcagaaatagaaggccgcaagcaagccatgcaggcgattgaagcgttgcgtcaattccagccaggatttgaacaggcacaattaaaaaatttcggtatgacggtgggaacaagagaatcaagacatattattgggcgagtccagcttacggaaaatgatatttgtaatgagggacgtcatgcggattcaataggggtattccctgagtttatagatggaaatggtcatcttaaattacctcttgaagcgaactattttcaaatcccttatggcgtaatgattccgcagcaagttgaaaacctgttggtttgcggacgggcaatcgatgcagataatttcgcctatgcgacaatccgtaatatggggtgttgtattgtcactggagaaggtgcagggactgccgctgctattgccattaaaaataacactaccgtttcacaggtagatattcagacggtacaggaacgcttacagcaaaatggcgtaaaagtcttttaacagggaataaagttatgagagaaaaacccagtttttatgtcgcgcttacaccgatcatttttatgatgatcgtgttggttgttggcatcggtgttatgggctggcctgccagcgtctgtttattaatttcagcggcgttttcctgcattattgcaatggctaagctgaaatatacctgggatgaaatccaggggtttattatcgataagatttcggcggtgatggcaccggtacttatcgttattttcgttggctttatggtcgcgacatggagctatgcaggtacactgccgatgctggtttattacggtatgttactggttgcgcccgcatggctttatgccatagcgttttttctgaacgcagtattgtcctatgtttccggggcatcatggggatctgtcgcttctattggtgttgcattaatgggcatcggttccggcttacatgccgatcttccaattctggcggcagccattgttaccggggcttattttggcgacaaactttcaccgttaagtgataccaccaacctgacttcagcggtaaccaaaactaaactttatgatctgattaaatatctactctggacgaccatcccatcaacgattattagcctgctgttttttacctggctgggaatgattcatacttctacgggctctatttcaccagaaagcatgcagatgctggtacagctcaaagagttatataagtttggtctgttaccgctactgcctatgcttattgttctgtgctttacctttttgcgtttgcctacagtaccggcattattaagcagtgcgttcgtggccgtattggttggatggctgtatcaaggtttcccgctggccgaaggtattaaggccacaatgagtggtttccgtctgacgatgatcactgattcaacgacgctgttaccttctgtgaaagaactgcttgaacaaggcggcctgaataatcagggcggattcctgtcatttattatctgcgccatgatgtttgctggcatcctgacgggaacaggaatgatggatgtcacattacaaagtgcggcaaacaaaataaaaagtgcttttggcgctattctggcaagtggtgttttagcggtcatcattaacttgcttaccggttctgatggtttgaataagattgttatatctgaattgatgatgaagaaattcgaagatcttaatttatctccattagttttagcccgaacgctggaagattttggcaccatgagtgcgccaataattccgtggtcagccgccggattgtatatggcgacgacgctaggtgttccgacgtttagttacctgccgtactgtgtattctgtttctgctcgatgatatttgcgttgatctatgcttctacaggtttccgtttactgcgcttcaacgaagcaaaggcctgagttattcaagataataaatgcgtttgccggatggattaatctccatccggcgttaatgtcaaaattccatgttctgcagaataatgtcagctaagcacaatctccagctcgcgcagttcacgccagaagcgttcggcaactggattcatacgggtattcatccggtatgcgtaggcctgaatcgggatcaccagttcgtcccgattaagcacaacgagctgcccgctgcgaatttcttgttggatggcgtactccggcagccaggcaatcccacagccgtcgagggcaacctgctttaatagctcgctcatcgaagagacaaaaaaggtgctgaaacttaactcgctgtggcgcgtcagggtgcgattaatcaatcgccccatgtaggagttgcggctgtaattcagtaacggaaagtgtggctgcgcgaggttaaacagtgcttctccgtgttcgtcacttgcgcagacggggaacaattgagattcaaataagcgaatgtggtcaaacggcgcttccagcaaatcttcgtcgtgaaaggaaaaaatacagtcactttgcccttcacgcagtttatcgaccgcttcatcgacatcaatggcttcaatcgcccaggtaaagagcggcggcatctggctgataatggacggtaacagaccgagggaaagagagtgtgcagcggcaatcttgattttacgttgcgcgtaatcgctgccgccacgcagctctgccaggttgctttctaactgttgcaacagatggcggatctgcgaatgaaagattttcccttgttccgagagttgcagcggcgtcacctggcggttaaacaattcaacgccaatcgcctgttccagcgcgcggatgcggcggctgaatgccggttgcgagacgttgcgactgactgccgcctgggaaaaattgcggcatttttccagagtcagaaaatcataaagctatttggtttcaatattatgcaaaaccgcaccacagtcatccattacgttttactctgtcagccgcccttgcgggcattctacgtccattcgggcggctgacaaccgtttaagccgtttcaaacgttcctttaacgcaggctttgccgtctttgaccatcagtttgccgcgagcgtatacctgctcaatgcgcaattctggcgtcatgaccagtaagtctgcgtcattgccaggcagaatttcgcctttcccggtcaggttaaggaaaccggctacgctactggtgagcgggcgcagggcatcgctgatactgaaatcatagtctttgaccagcacctgcacggtttccagcaatgtttcaaaacctgcaacaccgatatgggttaaatttccttcgtcatcgaagaacggctggctaccgttgccgtcggagctgagagtgacgcgtgccagcggaatacccgcctgaacggcgcgggcaataccttcggcaggggcgaccggttcgtcaatgctgctggtgatgtcgatggtgccgcctttgcgcgcgaactccagcgcctgctcaaacaacggaacgttgcggttaacgtgggtcggcagcagcttgctgatcggcacatcgcagttttccagcaggtcatagacaggctgtaacgcctttttgctgtcacccatgtggaacacggtgacgccaggtttaccgccgagcaaaccgccaacgcgggattccgccgccatattagccaggtgataaacgtccggtgcggcagaacggtgatcagagatggcgcatttcacaccaatcacgcgatcgataatcgccacgtctttttccacggaacccgtaatagtgcgggaagggacatgataagcgccggtcagcatccaggcgctgatgccttcttcattgagcgcacgggtcttggcgagcagggattccgggtggcgagagatagagtcggtgcccagcaggccaaccactgacgtgacgcccgcttccgtcagacgacttagcgccacttccggcgtgcgcgtcgtgggacctgcttcgccgccaccgccaatcaaatggacgtgttgatcaataaaacctgggcagaggatctgcccgctgagatcgacaaccgtgcagtccggtacaatgtcagaagggatgttgctggcaacggcaataattttgccgttagcgatgaggacatcgcaaattccccgatcttccggcgcatacaaatgcgctccctgcagcagggtaaaaccggctgcggaataatcaatcatggtaactccttgttaaacaataagctgcataacccagatcgacagcaatgcgttaatcacgcagaccgtaatgatatgcggataatatttggcattcacttcggctgtccccaggcagcgaccgacattttgcaccgggttgcccattaaatacatcgcgggcagtaaaacggtgacatcgtggccggttaatgcgccagcggtcgccagactggcggcaacaccgactgcgccgcccatgctcatcaatgcggctaaaaggacggttgccgcttcaccgggcaatccccacagcgccattacgggttcacagatatgtcccacccagtcgagcaggccagtaattttcagcgcctggatgatgacaaaggccatcaccacgtttggcagcaggttggtggtagcgatagtaaagccacggcgcgcgccatcaataaacatatccatgacgtttttacggacctgagttgtcatgcttgcgctccttgcgttgggttgcgacgttcttcgaagttaagccagacgcgcaaaatgttggctccgacaaatttaaacaccaggatgacggctaaaggtacgattacggacgtgcccagaaaggcaaacaccgcgacgccggaagagaagtagttggtgatgatggcgctaccgctggtttgataggcggcgaatatcactttatcacgttcggtaatttccccttcctgcgccagttctttggtcatacctgcggcggcatcggtgttttgcaggttagcaatcagcgccagtgaacagatgcctggaatgcccaacaacggttttagcacgggcgtcattaactgctgcgcggcgcgcaatccgccaagaccatcggtaatcgagataattcccagagagagaatcactgacggagccagttccagcgcgaagagaaagccatctttagctccagtgccacctgcgccgcgaaacgaggtggtagcgccattcgcaccaggcagttgcccaaacgatccgttcagaacggaaaagtcaaaaacgcgccaccaactgtctgtcccggaaaaaacaccggaaaaaaagataatcgtgagaaaaaaggccagataccctttaacacccactttttctgtcgccagctccccagctacagcatccccttgttgtgtcataacaatccccattgtttttttgtgtatgtgtgttgcttgagccaggaaaattcctggagctgaaaaaccttatcagccatgtgggtatggggaaaatgcaagtatgtttcttgctatgcgttttttgcatagcggaaaaatgacgctgtgtggcaaaggttctgcgcaggattgagttgcagaaaattcataaacccagtgacaatgacatcagtaaataaaaacagaaaattcagggacgaaaacgcgatggcaaaatacaacgacaaagagctggcagagacgagcaagtttttaagttttgtcctccgacataaaccagaggcgattggcatcgtgctggaccgtgaaggatgggcggatatcgataagctcatactctgtgcccaaaaagcgggcaagcggttaacccgcgcattactggatatcgttgtcgccaccagcgataaaaagcgctttagttattccagtgatggtacgtgtattcgcgccgttcaggggcatttgacttcgcaggtcgccattggcttcatcgaaaaaacaccgccacaatttctctaccacggtacggcaagccgttttcttgacgagataaaaaacaagggctgattgcaggggagcgccattacgtgcatctctctgctgatgaagcaacggcacgcaaagtaggagcaagacacggatcgccagttattttaaccgtcaaagcacaggaaatggcgaaacgaggcatccctttttggcaagcggaaaacggggtctggctgacatcaacggttgcggttgagtttcttgagtggtaagggaaacactcctcatgaagtaaccacttgcagcttaaataattgcgctgtgctgataagcgcagcaataaacaacgccgccgcgccgcagagagtggcgctggcaagcgccgatgttccattgccaagcatactggttagcgccgggccgaggatttgcccaatgccgtaaatgagtgtcacaaagcctaaaagattgagatttcccggtacgctcagttggcgggcgatagtcatcaccagagatgtcgtgcccataaaggtaccgccaaaaccaagactgctgatgataagcaagagaggcgagtcgctggcgagagtaagcaacacactaatagcctgcaccagcaaattcgccgtcaggcagggcaaagccccccaacgttttgctgcccatagccagccaaagcaaccaggcacaattgataagccgactaacgtccagagatgggcggttaacaatggtgagcctgcatctttcgccatgagcggcaggtaagtcgcgacgatgatataaccaaatcccgccaggccgtacagaatagccagtaaccaccagctcattatctgttgctccgtttttgccaatggcattggtgtgatggcgtgttttttcgagggcattaaaagcgtaagtgcaatcagcatcatgccagaaagcgccccggcgccttgccataacgtttgcgaggagaggtcaaaatgcaggcctgccagaacatattcattgcccagtgcgatgccaatgccaacgccagaaaacaaagctgccagcacaaaaggatggcgcgtgtgctgcataatcagcgtcgaaccaaaaatcagcattccggcgctggcgacacccgccaggacgcgaatcaataacaccagaataaatggcagcaaccatgccattgcgaggatcaacaacccgctcgccagggcagaagccaacagaaatgggcgcaggcgcgatggctggtgaaatgcgccaaacgaaaatagcagactgccagccagataccccgcatagttgccgctggcaatccacgagagctggctaaatgaaaacgatccttccgccatcatgacgggcaacataggcgtataaaggaagcggcctaaacccatacctaaggtcagaaccagcatcccgaaaagcgcggtgctgaaagaaaagcgttctacgggatgcgagggcgaaggcatgtttaaccttgtttgtcatttttgttgttaacaagttaataacaaaaaggtgaaacatgccagcctgttaatgcgatgattgaggggtaaagcgataaaaacgatttggttcgctaacgatataaatattaccagaggcatccatcgcaaccccttcggcctgtttgatgttatgcgacaaacctcgactgcctttggttagtgacatttcaccgataacctcgccaaccagcgttacttcctggagtgcgcgagattcatgagacagcaccagaagcgtatttttttgttggttaaattctgcgccggacacatcatctaaagtaaattgccgttgtagtgccttgtctttgctgatatgcaattcattgctacttaacagcccgttaactttgtagacttcaatcgggtttttctctttaaaaaaccagaaagtgtgatcctggcgagaataggccaatccttcaaaaccgcaattggttggggattcctgcagcgggatttttatttttttgaggatttttacttccgagtttggggtcagtgaaatcacataaatggcataatcgcgctcatcgctaatgacaaactgattatcgccaatgtattcgatcgtctcgagatccttaacaaaatccagaggaattgtgcggatcaaatcgccattggtggtcatttcaacaatggcggcaggtttgttgatagtgctaaaaagagtattgctttgtgccgaccaggtcagcgaagagatattattcgttatgcctgcaatttctttgccgtcaatggtggcgtggtaattctgaaatgatgctgcatgattgcttttacgggcgcaagattgcacgaagaaagtacacactgccacaatgacaaaaagaatcacaataacgaagatgcgtttacttaacgaaatactttttgtcacggtaatccctttaaggcaaatcaataagatatcgagaagtatacgtagcgatcttaatgaatccttaacgcggagaaatcccgtaatgtgcaatgcagcgccagccaccatcctgctgacaataaactgattccgtatgcccagggatcacccattgaatttcctcgccaggcggacaggtcagccaaatgcataacccgcagccgccgcgtaaatcacggggaatatcgctgacgcgaaaagtcatgcccgctgcctgcaacgccttgcgggtttgtatgacgccgaccgtggagtgaaataaaaacagatactctttcatgcgcgttttctctgccgctgaccgatcaccgccgcgccaattgcaccagcgaattgcgcatcagggtgagtatttaccggcattcccaggtgagattccagcatccgggcaaacgtctggcaatgactaacgccaccagtaaacagaatcggcgcttcacaggagagacgagcaatgaaattggcactccgccgcgccatcgcgttaatcactccggcgagaatcgcttctggcgctacgcccgcagagcgcaggctgatcacttctgattcagcaaacactgtgcacatactcgtgatggcgtgcggcgtgacattttcggtaatgctgtcgagctgttcgacgctggtgccaagcgtgcgcgagatcacctccaggaaacgcccggtgcccgccgcgcatttgtcattcatcaggaaatcgcacaggttaccgtcatcatcaagctgaatcactttgctgtcctgaccaccgatgtcgattaccgcgcgcgttgctggctcaagaaaccgtgcgcccagcccgtgacaggagatctccgtcacttgtttatcggcaaaatccaccagttgccgtccgtagccggtgagcgtcagaaacggtgttgtctctaacccttcgcgcagagtttcccaggcttcagtaattgctgttgccgggcgaaagggtgttggaacgaggaaacggcgcgtaatcacgccgtcagccagtaagatccctttggtggtggttgagccggaatcaatgccaatcgaatatgtcactgccactccttacagcatctcaataaaggccgcgacacgggtgctgagctgcccgacatccgaggtggagtagtctgtttcaatagcgatataaggaatgttgtgctgctggcgcacatgacgtttaatcgccagcgattccaccgcgtaggtatggcacgcctgcaaaatcacatcaactacgccatcgacctgatattcttcaaccatctggctgagcatttgcaggcgctgatcgttcggcgaaacacaggagcagccaatcgccagatatttatccgccagcgcgtcgtacacatcacccgtttccgccacgcattgctcggtggctttcgccccggtgcagttttcataaccgacaacccagccgccattctcttcaatcgcgcgcaccactttctctgctgcgccgccaattgggcagccggtgattaaaatacgtgggcgcgggtccagtcgctggccttcttcccactgctgacgaacgcgggcggtcattgcatccagttcattgatcaacgcctctttatcgaaccggaaggttgcgccgtagactactttcagaatgtcgctgccgctaagcgccggaggatttaactgccccaaatgataaaagttggccagtgcgcgacgttcgcggtttttcagcgcaatggcatcgcgcagagcatcttcgctaatctcgtgcccaaaacgttcttctaccgttttttgcaagcgcagcatctcggctttccataatgcacgcgaggcatcgtccttaacgctgtttggcagttgcatcacatgaacgggcttaaactccgccatgtattcatacattttctttttgccgtcgcaggtggtttcaccgaccaccagatcagaaaagtagaagtaggggcatttatcggttttgccgaagccgtagctgcttttaatcagcgggcagaggttgcgcggcagatctttctcggcttcttcaatggtttcatcagaggtggaacatagcgaaaccacaaccgcaccggctgccatcgggatctcttgcggcataaaggtgcagtaggtgccaaccagcggaatgccgcgctccttgagatccatgacggtgagaaagcctttctggcgagcttcagagaactgatcgaaaatggcgggtagatcggtgacaagtgacatgattttccttccccgtaccacgggagataatgaaaagaggccacattattaccattcttttagtgtggtttatttgatctctctcgcggttagccacttagtttttcatggatttctataaattgccgagggggaacaaggccgggagctgcgacagcaaatacaaaataagtccaatacaaccgccaaccagcgtaccgttgacacggataaactggagatctttgccgatatttaactcgatttgccgcgacatatcccgtgcgtcccagctttttaccgtgtcgctgatatggcgagtcaggaatgcggaaaactcaggcgcaacgcggtgtgcggcttgttcgagatgaccatttaacgacgcccgcaaggcatcatcggcaattaacgtttcgccaaaccattgccccgcccgcgcgatacgttctttcacacgagaatcttcactgttgatatccgctttcagccattcccgtaaatccccccacaattcactgagatagcggttaaaggcctcatcttctttcagatagctttttacggcatcggctcgcgctgccatttccggatcgtttttcagcttgtcgatcagggcaaaggtggcgtgatcaaacgcatggcggatctgatgcgcacgatcgcggctgatatcatcaagcaaagaattcaccgcgtcagaaaccaactccgcgctatgttcgcccagccattcagtgggcaaaattttggctttcagtggatgctcgctctccagccagcgaacaatttgctgggcaataaacttgcgtgatttatcgcgctggagaagggcgatcaactgtgcgatcagcgtatccagcagcacctgatgacgatcgtttttggtcatactctccagcatcaacgcactggtgccagaaagatcgactttatcaatcgcccggtggaccgcgcgcttaagcaggcgctgaatacgcgcatcatcggtcagttcgagaaaaccgctcatgatctgtaacagatgctgaccaacgcggcgggcgttctccggctgactaaaccagttgccaatcaacaacgccggttcgtgacgtcgaatcaatgccaccagcgattgggtatcgagaaatttttcctgcacgaactggccgagattttcgccaatccggtctttattacgcgggataatcgccgtatgacgagaaatgatcggaatcggcacgcggcgaaacagcgccaccaccgcaaaccagtccgccagcgcgccgaccatcgccgcttcagcaatcgccttcacaccgctcacccaaaaattgggcggcaaaaacagcgtaacgacaaaggtagcagcggcgataagcagtaaagagagcgccaacattttggcgcgtctgagttcaatgagtttattcatatcgtaagaatagagcctgacggtaagaaaacgcaaaaagcgagatatcttccataaaaatgtatcgtttgcagaagaataaaaatagcctggaaaccgcctcggggaataggaaatagccaggtgtgaatggctttgttagtcgctaaagttgggccatcttatctacaggtgacggatcgccatgacaaactttacgaccagcacgccgcatgacgcattatttaaatcctttctcacacactctgacaccgcgcgggattttatggagatccacttacccaaagatttacgtgaactgtgcgatctcgatagcttaaaactggaatccgccagctttgtcgatgaaaaattgcgggcgctacattccgatattctgtggtcggtaaagacccgtgaaggcgatggctatatttatgtagtgattgaacatcagagccgtgaggatattcatatggcctttcgtctgatgcgatattccatggcggtgatgcagcgccatatcgaacatgataaacgccggcagctaccactggtcatcccgatgctgttttatcacggtagccgtagcccttatccctggtctttgtgctggctggacgaatttgccgacccaactaccgcacggaagctttataccgccgcgttcccgctggtggatatcactgtcgtgccagacgacgagattgtgcagcatcgcagagtcgccctgttggagttgatccaaaagcatattcgccagcgcgatctgatggggcttattgaccaactggtagtattactggttacagagtgtgctaatgacagccagataactgcgctgttaaattacattttactgactggtgatgaagcgcgttttaatgagtttatcagtgaaattacccgtcgactgccacaacaaagggagcgaataatgacgattgcagagcgaattcataatgatggatatataaaaggggaacagcgcattcttcgattgtttttgcagaatggggtagatcctgaatggatacaaaagattaccggactttcggcagagcaaatacaggcattagagcagcccttgcctgagcgtgagccttattcatggctcaagagctaatcagagacggatgacaaacgcaaagctgcctgatgcgctacgcttatcagacctacattatctctgcaatctattgaatttgcgcggtttgtaggccggataaggcgttcacgccgcatccggcatgaacgaagcacactttacgtggcgatgatagtgaccttcctgcaccaaccttgccgccgccatttatgtgaacggtacattaacgctgctggtggcagcaaatgcagacccggtgcgtgttacagcaggtgagagatgaacggttaaaggatattgggttatgcagggaggatgtggtgtaatggagagagtccttcacgaaacgatgggatttatatgtcacctcgtcagataaggggttattattgcgaaatcatcgcttcacggaaagacgtcagaatgaaagctacagaagcccgcctactcgattttttaaaacgttcgcagcagttcgttattaccatttatcaacggacttattcatggacagaacaacaatgtcggcaactttgggacgacatcattcgtgccggaaagcgtgacgatatatcagcgcattttatcggttcggttgtttatattgagcaggggttgtatcaggtttctggtatttctccgttactggtcattgatggtcaacaaaggctgacgaccgcaatgttgctgattgaggctttatcgcgtcatcttggcgaagacgaagtttttgatggcttttcagcaatgaaattgcgtaattattatttactcaatccttatgagtccggcgagaaaggatttaaattactgctgaccgagactgataaagacagtttgctggcgttaataaaacaaagaccaatgccagaaaactattcccatcgaataatggaaaactttactttctttgatgaacaaattaccaaactcggtgatgacttgatccccttatgtcgtgggttagcaaagttattaattgtcgatgtggcgcttaatcgtggtcaggataatccgcaactgatttttgaaagtatgaactccaccggtaaggcattaagtcaggccgatctggtgcgcaattttattctgatgggcctcgaaccagaacatcaaacccggttgtatgaagatcactggcgtccaatggaagtcgcgtttggtcagcaaggttacagcgaatattttgacagttttatgcgtcattatctgacggtaaaaacgggggagatccctcggacagatgaagtctatgaggcatttaaactccatgcccgcagccagagtgttgctgaaaaaggcgtagatcggctggttgaagatattcacatctacgcggagtattactgtgcaatggcattgggaaaagaaagtgacaaatcgcttgctacggcttttcaggatttgcgcgagttaaaggtcgatgtggcgtatcctttcttactggcgctttatcatgactataaaaatggcgttttgtctcacgaagatttcctgagcataattcgtttaattgaatcttatgttttccgccgtgcagtatgtgcgattccgacaaattctcttaacaagacgtttgctactttttataaggtcattaataaagaaaaatatctggaaagtattcaggtacattttctgaatctgccttcatatcgtcgtttccccaacgatgatgaatttaaacgggaattaaaagttcgtgatctctataatttccgtagtcgcagctactggttacgacgactggaaaacgataaacgcagagagcgcgtggaagagtttacgattgagcatattatgccgcagaacgaaaatttgtcggctaaatggcgtgaagagctgggaagtgactggcaacgcattcataaagaactgttgcatacgttggggaatctcacattaacgcgctataactcccgctacagtgacagacctttcgcggaaaaacgcgatattgaagacggctttaaacatagcccgctctatttgaatatcggtcttggacagtgcgaaaaatgggatgaagcagccattcgcgcccgtgcagatcgtctggccgatctcgcggttcaggtctggcaagcgcctgctcttcctgaagaggttttagctgtttatcgggcgcagccggagaacaaaaccagttacagcctgagtgattatccttttcttgctgatggttcgcatagccgggtgttatttgatcatcttcgcgatgaagttatgcgcctggacgcagggatcacgcaggaagttttaaagctctatattgcgtttaaagctgaaacgaattttgttgatgttgtaccgcaaaaaagccgactgcggttgtcgcttaatatgcagtttcatgaactggtcgatccgaaaggtattgccaaagatgtgacaaatgttgggcgatggggcaatggtgatgtggaaattggtttcagtgacctcgcacaacttccttacattatgggattaattcgtcaggcatttgaaaaacagatggagagcgcgttggtataacgtggcgaataatacccggtagcactggcgctaccgggtcaatgtatcaggcgactttctgtttacccgcaatcaccccaataaactcctgcacctgcctttgtttacgcgccgacagcttgcacacctggcgaagcgactgcatcagttcgctctcttcggcggcggggggttgggcggtgaggacaatacagccttccatcactttgacatctatcgccgtgccagtggcaaaaccggcggcttccagccactgacctttcagggtgatggcgggaatacggctgtaatccgggtagcgactcgcataactcacggttaattgacggttatttgccggggagacttctgcttcgaacggttgtgcaatagaatgcgtgtcagtcatgattactattctccataaatagtgattgtgatgagcggtgcgggtgtgttggcgcacatccgcatcgcgctaaatacctggatatatcatcagtaaatacagggaaagtccagctaaaaatagaataaaatgggaagtttctggaacgatttaaatatatttgtgtgagttatgattggcgtaaaaataataaatagcgcaccagaaaggtgcgccagaaaataatgatcaggactttttacgcgaggcttttttacccccgctggctgcgcgttcagctttgattttctccagcaacgcggcggcgctgttttcaccgctgattaattccgggttttcggcccgccactgggcggtgagttcaccacggaacgcttttgccaggatggattgcgtcagattgttgacgcgggctaaggcgttgttgacctgtttttctattgtgtcggcgtaggcgaagagttgctcgacgcggcgaacgatttcagcttgttcgggaagggggggaacagttattgggtatgcaattaatttctgtgcattaatatttgattgactgaccccatcagatttaactgaatagcaatattgtctccccaaaatgctatttaaatggtagttaagatagtcagggtttaaatcaggtaaacattgaaccctaatcaaataacctgcataaatagctggttgctctgatttatatatggctgttttcccgacaagttcaggactatttgtacgattgaataatacatcattgtactcaagtttatacttttcaatttctatggtatctgacgtatagactagatccgtccagtccaactttcctccctgaagattgcccattcttaatacaggaatgagtccttctttattagacttagatgacgttccgtaacttggtttttttataaactccccaagtttgccttctctccacccagacaggcttgaattatctctccagtcttcagttagttttcctctcaccgctgcacccagaaccgcctgacgaaaacgtttcaggatttgtgggatttgctcaagacgtgctttggtgctgtctacctgtgccagcagcgtatcgagtttttcagcgatgattttttgttcggcaaacggtacaagaacaaatggtaatgttttcgcagaactaccagaaatttctttaaaagttgttcctgtgcccatttcctctgcaatatgtctgatgttgcggagaaagtaatatgcataatcaggaaaaatgtctgaaggaaaagcaaaacttttgaaaccctggttagtcgcaatctcatttgcagcaatagcaacatatccaatcggtgcccggctactaaaaagtatagtgcctttgggcattagttttgctgaacaagaggaatagcctagtgtagttaaatctctggcaccatgtgagatatatttctctttataaccgctcaaatcggcaggcgtaagccaggcgactccctcacccgaaggtgcaaaattttcagcgactcccgattttggtgtcccaccagagatgacatcagcaatgtcgcctatttcaatctgttcccacccctccggcaatttcccagcactcattccttcaccccaccaaatgcttcttccagcaactggcgctgcgcatccgcctcatcgctcgcccccagttcacgcatcagcgcatccagttcagacagcgcctgtaccagttcacccatcgcttctgccgctaatacatccggctccggcaggttgtcggcatcaatactgtctttatctttcagccaggagatatccagcgaatcggatttcgcggtgcggatccactcgcggctgaacttgcgccagcggctggtagcaagatgctggtcggtgtttttgttctcttcgctgtcggcaatttccgtctcttcggcgttaaaactccattcaccttcagtgcgcgggcttaagccgtgcgggtcttcgccaaacacgcgctcaaacggttgcaaatgctcgtcggtaaacggcgtgcgtttaccaaagctcggcatattggtccgcaggtcgtacacccacacgtcatcggtgcagttcttatcctgattcgggttcgccaccgtccctttgataaagaacagcacgttggtcttcacgccctgcgcgtaaaaaataccggtcggcagacgcagaatagtgtgcagatgacacttatccatcaggtcacgacggatgtccgtacctttgccgccttcaaacagcacgttatccggcaccaccaccgccgcacgaccgccggggtgcagcgtttcgataatatgctgcataaagcacaactgtttgttgctggtcgggtgaacaaaggtgcgggtaatgttggtgcctgcggcgctgccaaacggcgggttagtggcgacaatatgcgccttcggcaggttttcgccgtcgctgcccagggtgttgcccagacggattgcgccgccgtggtcgaggttgccttcaatatcgtgcagcaggcagttcatcagcgccagacgacgggtgccgggcaccagttcgaggccgataaacgcgcggtggatctggaaatcctgcgtgtcgccatcaaggtcgtccagatcgttagtctgcgacttaacgtagcggtcggcttcaatcaaaaagcccgccgtaccggctgccggatcctgtaccacttcacgtggctgcggtttcagcagatgaataatggttttaatcagcggacgcggggtgaagtactggcccgcgccagacttggtttcattggcgttcttctgcagcagcccttcgtacatatcgccgaagtcatcgcgcgacttaccgtgcgcaccgttgtaccagtccagtgaatccatattgctgaccagtgcggttatttgtttcggctcggtgatggtggtactaacattatgaaaaactgcctgtaccagctttttgtcatcttcgcctaaatgcacgagcatttttcggtagaactgcaactgctcctggccgatgcgggatttcaggtcatcccagcggtaaccttccggcaggtattccgcttcctgcccggtctctttacacattttcaaaaacagcagcgaggcgagttcattgacgtagttttgataggaaacgccgccatcgcgcaggttgtcgcacagcttccacagcttcgcgaccagatcgttattgttcattgtgagttccgtaaattaaacaacggcccgcattgtttggggccgcagaagaagaaattgccgagggtaatatacacaaaatcattcaggttgcatcaaggcggcaagtgagtgaatccccgggagcgtacagaagtacgtgaccggggtgaacgagcgcagccaacgcagaggcagcctgaaggatgaagtgtatacgtgtcaggccagctcgtcccagatataatcgctgaatttatcaagcaggttgtcgagattatcgtcaaaggttctttgtagcatcgccttaccgccgcggcggtggaagttgccggttttgaagacatcgtcgtcgagcaccactttctctttcagcgcctgcgctaaacgatcgagccagcttaattgctcgctgctccagtcgttttcacccttaatgcgcgtcagcgcgtgatcgacacgttcctcaaacggtttcagcgcatcgcccaccgcagcgcggcgaatatgaccaatcagccgggcggcgatatcttcattgcgcgtctctttccatgctttgcgcagggaagattcctcaaaatgctggcggtcaaaccactcctggagctcgaccagccctttacgggtgagatcgcgcgggcgattgatcaccgcctgcaatgccggctgcgcgttcggggaacgttgcaccagcgagtcaaaggcttcgaggaaatcctgcggcgtgtcgtaatcaccgtacagcgattttacactcaccacttcatcgtcgatatcgaggaagatcggcgcatcattcaggttgttgatgtccgttttcagcttttccagacgggcgataaagccaggcagtttgttaaagacttcggcgctccagtgcggccctttttcccgcaggcgcgaggcgaagccgttaaagttcacgcccgccgcgtcctggcatagctcatccagacgacgcacctgtttatctatcgtttcgctgcggtcacggttaaacgtggccaggccgatgatgcgctggagcttcgccaccaattgttcatggctgtgctcggcaaagctacggccatccgcttcggtgattttataggtttctgaatcggtaatttcattgaccagcgtttgcagttccaccttcggacgcaccaccaccggacgcatggtgtcgacgctctccagcgtgctgtagatatcgacacagtcgaaaatcttaaagctggttttattcacgtccgggcataagcgcgtggcgcggcctttcatctgctcgtacagaatacggctgcgtactttacgcaggaacacgatattacagatcgacggaatatcgacgccggttgtcagcaggtcgacggttaccacgatattgggcagccgctctttattgaagcgggtgatcatggtctgcactttgcgcgcgtctttatcggcatcaccggtgatcttgatgatcgcgtcgtgctccagttgcggatactttttcttgaacgcggtacgcaactcttccaccaccatatcggcatgggcattggtaacgcagaagaccagcgttttttgcgacccggtcgggtcaaggtagttggtgagctcgttacagacggcgcggttaaacgccgggatcaccaggccacggttaaagtcggcgacctcaaaatcctgatcgtcttccagggtatcgttgatcacttctccctgcgggctgatgcgctctacctgttcgcccttggagagataaaccccctcctgggcgttgcgggtgatgatctgaatcggcggatcctggtcgatcagaaaaccgtcgataaccgcggtacggtaggtataacggtaaaccggctcgccgaaaatctgcaccgtatgcagcgccggggtggcggtgagggcgatttttaccgcatcgaagtgatcgagaatgcgacggtaggcagaaacgtaatccagctggctgcggaactgcagctcgccttcggtctgctctttatcgagaatatagccgcgatgcgcttcatcgacgacgatacagtcgtaacgggccaccggcatcggttcatctgattgtagggtgcgtttcaccagcgactgtacggtggcaacgtgaattttggtgctgtcttcggggaatttatccgtcagccctttaatgtcgaaaatgctgttgaaggtgtcgccgttaatacgcgtatcttcaaacgcccccagtgcctgctcgccaagagaacggcgatcgacaaggaagagaatgcgtttaaaacgctgggactggatcaggcggaacatcatggcaattgcggtgcgggttttaccggtaccggtcgccatcgccagcaggatctcttgttgacccttgacgattgccttttccaccgcgcggacggcatcttcctggtaataacgcaggcccagctcgctcatgcccgggttatcggcaaaccactgattctgtttttgcggttcgctgccgagcatttccagcagctcttccgggcgatgccactcgggtaaggctttcgacatattgcgggtatcacgcacgtcgcgataccagatgccacttttagtcttcattgctgcgcgatattcgcgcccgttggtggagtagcagaaggggattttaaaccgttgttggccgctggtgtcctgccagctagtttcatactccggcacagcttcatgcacttcatccggtgagtaatgctcaagcaaggtttcccgcaggaagccattatcgaagcatttgctgtagcgatacgactcattgagcttgccgggaacgtcgatatttttacgtttcgcctctaccaccgcgatgggcttgaggccgacaaacagcacataatccgcaaagccctgattacccgtttcatctttcccggtcggccattcggcaatggctttattgacgccgggttccgggcgtgcgcctttggagaagcgcagggttttgctatcggcctgccagcctgctttacgcagttgcgcgtcaatcaggaagcgactctcttcttcgctaaggttgagtgtgcgcttgatggcctgatcggtaatttctttgtggtaagccttacgttcctgttcggtctgtttggccagctccgcgttcttctcggcgagctgtgcttccagcgccgcaaggcgagcctgggtttgcgcttctgtttcctgctgtttgccttccagaatggcgatatagccgttcagggcaaccagcttctgctgttgcgcttcgacttctgcctgagtctgcgctttttctcgcgcctgctgttcaagctgttgttttagcgtcagcacttcctggtgatagaggttttcgccacgttccggcaacacaaataccggcaccgggaagtcataatctttggtgaccagacggtagtaccagacagccaggcggaacccgagtcgcaggcacatctgggcatcgtcgagatcgttatggtattcgtgcaccgcctggttaccaatgcggcgtaatttgtggaatacagagagaatgttgtcatcaacgaaggcgattttgccgagttcgcgcaggagatcgtgttgattctcacaaggggggatgttgagtaacagaccaagatgtttcgctgtagcttcgccaaacatacgcattttaatcagcgtcgtgttgggatcatccgggtagttattttccgccgcacaggcgatggcataagtgaagtcgttgacgcccttcaggaattcgaagttggatttattcatcattgttattaatccattgctgtgtgggcctgtccaaatatttaaggcccataacgccctatcttagctttctgtacctttccgggcaatgaccggagtcacagcaactgactcatttctaacgtgttcgtctattttggtagtgttatagtagccgaaaaacatctacctgattctgcaaggatgtactatgacggttcctacctatgacaaatttattgaacctgttctgcgttatctggcaacaaaaccggaaggtgcagccgcgcgtgatgttcatgaggctgccgcggatgcattaggactggatgacagccagcgatcgaaagtcattaccagcggacaacttgtttataaaaatcgtgcaggctgggcacatgaccgtttaaaacgtgccgggttgtcgcaaagtttgtcgcgtggcaaatggtgcctgactcctgcgggttttgactgggttgcgtctcatccccagccaatgacggagcaggagatgaaccatctggccttcaattttgtgaatgtcaaacttaagtcacggccggatgccgtcgatttagatccgaaagccgactctcccgatcatgaagaacttgcaaagagcagcccggacgatcggttagatcaggcgctaaaagagcttcgtgatgcggtggctgatgaggttctggaaaacttattgcaggtttctccttcgcgctttgaagtcattgttctggatgttttgcatcgcctggggtatggcggccaccgtgatgatttgcagcgtgttggcggtactggagatggtggcatcgatggtgtgatatcgcttgataaacttggcctggagaaagtttatgttcaggcaaaacgttggcagaatactgtaggcaggccagaattacaggcattttacggcgcactggctgggcaaaaagcgaaacgtggggtgtttattaccacttctggatttacttctcaggcgcgtgactttgcccaatccgtcgagggtatggtgttggttgatggggaacgcctggtgcacttaatgatcgaaaacgaagtaggggtttcttcacgtttgttgaaggtgccgaaactggatatggattattttgagtgaaatatcaggccggatgcggctgcgccttatccggcccataaccccttacttcctcaaccccgcaaacgccgcccgaatctcatcctccggcagctgaatcccgataaacaccatcgtgctatgcggtttttcatcgccccacggcctgtcccagtcggcgctgtagaggcgctggacgccctggaacagcaggcggttaggttcgccgtcaatccacagcatccctttgtaacgcagcagtttatctgccgattccagcagcaggttttccatcacgcgggaaacttcgctgatatctaccgggtaatccagttccaccacaatcgacgaaatatcgttttgtttgtccgcgataaagtgaaaacgtggcttggtgctgacgacgttttcttccagcataaaaccgttggtgttgaacaacaggcccaggtcgatgtcgccgtgggtgacggtgtagaccggtgcacgggcgttgatgcgcgccaggcgttcacgcagtttttctgcttcgcctgcgacgtcggttttagtcagcagaatacggtcggcgtagccaacctgggactgggcgatggtgaactggttcatctgctcatcggcatgtaccgcatccaccagcgcaatcacgccatccagcaggtaacgctggcataaaatctcatgggagaaaaaggtctgaataatcgggccgggatcggccatgccggtgcattcaatgaccagacggtcgaactgaatattgcccttgtcgagattatccagcaggtcgagtagggcgtcttccagctcgttggagcgcgaacagcagatgcagccgttggtcagcgttttgatctgcgtggcgcggtcgccaatcagttgatcatcaacggagacttcgccgaattcgttttcaatcacggcaatcttgtagccgtgttgttcgttaagaatatggcgcagcagggtggtttttcctgcgcctaaaaaaccggtgagtagggtaactgcaatcgggttcatgctctctccattaacaacagcgcataccgcctttaccatcgccgccgtagcgcgcgttctggcgttcgcggaagaattcttcatagctcatgtacggcttgtcgggatggttggtcttcatatgctcgacgtagttgtcgtagtctggaatgccaatcaacatcttcgccgcctggccgagatatttttttgcctgtcctaagttaccaaacattttgccttccagatatgcgtaaagcccggaaggtccgggctggggatttgccggatgcggcgtaaacgccttatccggcctacgatagacattttgtaagccggataaggcaaccggttagtggtgcgaagagatcttcacgccgccttccgggattggaacgtacggtgtttctttgtcagtacgtttgtcgctgttacgcaccttcagccaggttttgaaaccgtagaagatgatgctgtacaccacaatcaggaacagaatactcaggcctgcgttggtgtagttgttcacaacgatgtggttcatgttggcaatctgctgcgccgtcaggtcagtaccgttagcaatcttctctttgtactggctcgccatgtagaagaagccttccatctgcgggttggtgctgaacagtttcaggcccagcgcccaggtggtgcagataagcagccatactgccgggataacggtaacccagatgtattgggtgcgcttcatcttaatcagtacaacggtgcccagtaccagcgccacggctgccagcatctggttggagataccgaacagcggccacaggctcttaacgccgcccagcggatcgaccacgccctgatacagcaggtagccccacagacccacacagcccgcagtaccgatgataccggcaaccagagagtcggtttttttcaggaacgggatgaagttacccagcaggtcttgcagcataaagcggccagaacgggtacccgcatccagcgcggtcaggatgaacagggcttcgaacagaataccgaagtgataccagaagcccatgtcagccatcggcagcactttgtggaacacgtgagcgatacctaccgccagcgttggcgcaccacctgcacggttcaggacagaaggctcaccaatgtctttcgcggtttgcaggatctgctctggcgaaatcacgaagccccaggagctgacggtcgctgccgcgtgtgcggtaacgtctttcagctgtgccatgatgatcggcgcgttctcgccacccatttcatgcaggttaggcatggtgatgccgaggccagcaggcggggtgttcatcgcgaagtaaagacccggttcgatgatggacgcagcaaccagcgccataatcgccacgaaggactccatcagcattgcgccgtagccgatgaaacgcgcgtcggtttcattagccagcagtttcggcgtcgtgccggaagagatcagcgcgtggaagccagataccgcaccacaggcgatggtgatgaacaggaacgggaacagagcgcctttccacagcgggccagtaccgtcaatgtactgggtcatggcaggcattttcagttccgggttcagcaccacgatacccagcgccaggccgacgataacgccgattttcaggaaggttgccagatagtcgcgcggtgcgaggatcagccacactggcagcagtgcggaaacaaacgcatagccaatcagcgcgaaagtaatggtggtatctttaaaggtcagtgccggaccccagtacggatcgtgagcaatcacgccaccgaagtagatagaggcaaccagcagcacgataccaatgacagagacttcacccacacgccccggacgaataaagcgcatgtagatacccataaacagcgcaatcggtacggttgagcaaacggtgaagaccccccacggactttcggccagggctttaaccacaatcagtgccagaacggcgaggatgatgatcatgattaagaaacagccaaacagcgcgatagtccccggtactggtcccatctcttctttgatcatctcaccaagagatgcgccgttacggcgagaggagataaacagcaccataaagtcctgaaccgcaccggccagcacgacccccgccagcagccacagcgtgccaggcaggtagcccatctgcgcggcgagaaccggacccaccagcggaccagcaccggcgatagcggcgaagtggtgaccaaacaacacgtaacggttggtcggaacgtagttcagaccgtcgttgttaataaccgcaggcgtcgcgcgcgtggggtcgagtttcatcaccttctgggcgatgtacagactgtagtagcgatacgccaccagatacaccgacacagaggcgaccacgatccacagggcgctgacgtgctccccccgacgtaatgcaactaccgcgaggcagaatgcaccgatgattccgagaatcacccaaggtatgtgcttgaatatctttttagtatccatagtaaaacctggcatgtattgattaatagttggccgaagccgttctaggtttgcgttgcgtttgaggaggtaaattgaccgctatcctgcagtgatgttgccagagttacgcgcgcgtaaagtaaggtaaataactgagtggttattttagggacgtaagcggtcaggaatggcggtgagcggcaaaggcgtcgtttaagtgaccataaatatgtgatttatatcacatatttatattgcgaataatttatgtaaataatggctttttaaattcagggggtgaataaaattactcggcgtcatctccgcgggattttcataaagtttttcctttccaggccgaaaatcttgcatcggtccacaggaaagagaaaccatgttaaaacgtatcaaaattgtgaccagcctactgctggttttggccgtttttggccttttacaactgacttcaggcggtctgttctttaatgccttaaagaacgacaaagaaaatttcactgttttacaaaccattcgccagcagcaatccacgctgaatggcagctgggtcgctttgttgcagacgcgtaacaccctcaaccgcgcgggtatccgctacatgatggatcagaacaatattggtagcggttcaaccgttgctgagctgatgcagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatacaactgttaggtgcaggcaaaatcaacgagttctttgatcagccgacccagggatatcaggacggtttcgagaagcagtatgtggcttacatggagcaaaacgatcggctctatgatatcgccgtcagcgataacaatgcctcctacagccaggcgatgtggattctggtaggcgtgatgatcgtcgtactggcggtcatcctcgccgtctggttcggtattaaagcctcgctggtagcgccaatgaatcgcctgattgacagcattcgtcatattgcaggcggcgatctggtgaaaccgattgaggtggatggctctaatgagatggggcaactggcagagagtttgcgccatatgcagggagagctgatgcgtaccgtcggtgatgtgcgcaacggggccaatgccatctatagcggtgccagcgaaatcgccaccggcaataacgatctctcttcgcgcaccgagcaacaggccgcttcgctggaagagacggcagccagcatggagcaactgaccgcaacggtgaaacagaatgccgaaaatgcgcgccaggccagccatctggcgttaagtgcttccgaaacggcgcaacgcggcggcaaagtggtggataacgtggtgcagaccatgcgcgatatctccaccagttcgcagaaaatcgccgatattatcagcgtaattgacggcattgccttccagaccaatattctggctttgaacgcggcggttgaggctgcgcgtgcgggtgagcaaggacgcggttttgcggtggtcgcgggagaagtgcgtaatctggcccagcgtagcgctcaggctgctcgtgaaattaaaagcctgattgaagactcggtggggaaagtggatgttggctctacgctggtcgaaagcgccggggaaacaatggcggagattgtcagtgccgtgacccgcgtgacggacattatgggcgaaattgcttctgcttctgatgagcagagccgtggtatcgatcaggttggcttagcggttgctgagatggaccgggtaactcaacagaacgccgcgctggtggaagaatctgccgccgccgccgccgcgctggaagaacaggccagtcgcctgaccgaagcagtggcagtgttccggattcagcaacagcagcgtgaagcatcggctgtggtaaaaaccgtgacgccagctacgccgcgcaaaatggccgtggcagatagcgaggagaactgggaaacgttttaacgtaatgatgccggatgagtatttcatccggcgtttttattattaaaccaggaacagtgaaatcgccgggatatatgtcaccagcattagcattaacagtagagccgccagtaggggcagggattgtttaaagaaatttcccaccgaaacttgcgtgatattacataccagcagcatcacggtacctaccggtggcgtgaatgcgccaatcgacaggttgaagatcatgatgatgccaaaatgcaccggatcgatgccaaagtgttcgaccaccggttttaatagtggtaccaggatcagcaaaatggcgtttccttccagaaacatccccagcgtcagcagcaatatgttgataatcaacaggaacatgtatttgttttcggtcagcgaagtcacaaaattcgccactgcgacaccagcatgttccattgagaaaatccatcccaatgcggcgctggccatgattaccagcatcaccgatgcggttgcgcgtgccgtttcgcccaatgctttgacgacatgagaaatccgcatttcacgatagataaaaaagccaatcgccagcacgattagcaccgctactgcacctgcttctgttggggtgaaaatgttagcgcgaataccacccaccacagcaaaaatgaggaacagcgcaggccaggcctgtcccagcgagaacaccacctctttgcccgtaggccagctttcacgcgagggtttagcgttagttttgcgggcgacaaggtagacggtaaacatcagtacgactgcgcatagcaaaccaggtaccagtccggcgataaacatttttccgatagagacatcggcaaccagaccgtaaataatcagggctattccaggcggtatgatcggggtgactaacgagccaccagcggtaatggcggcggcaaacgcgcgattgtagcctttacgttccatctccggcaccatcatgcgcgacagcatcgccgcgtcagcaaggttagaggcgctgacgccgcccatcatggtgctgacgagaatgtttgccacgcccagtccgccgcgcattttccccaccagaacgttggcaatgtgcaggatgcgttcggcaatgccggtgtagctcattagtgtgccgagcaagataaaaaacggaattgccagcaatgatgggctttgcgttggcgcgattagtctttgcacggcaatttcaatcggtacgctggagaagaataaaaagtaagcgatgatgccaataaacatcgccagatagacccgaatgttgagaaacaaacagacgatcattagcggaataatcaataaccaactcattgcattttgtctccgctatcggattgttttgtatcgtttattaaccagtagagggtataaatagccgttgccagtgcgccgacagggaccgccagatcgatccagaaccaggaaactttcagaatttgtgtcactttaaactgcgccatttcggctagtcggtagcccagccaggccatataaagcagcagtgcgatggagagaagggcgaccagtactgcaataacacgcctgagtttgcctggaagcatctccatcaggaagggaatggtcaggtgcgccctgtcacgttccgccaccactccacctaacatcaccacccaaatcatcagcattcccgacatttcttctgtccattgaagcggttggccgatgaaataacgcataaataccgctccaattgtcaccacaaccagaacgaatagcgcaaaggcagcactaaattctgccactttgccaaaaagacgcatgaaacctcctgttagtgcgtgtcctgcctaagagagatgaggcaggacgctgagcattaatgcttattgcagttgctgttgaatggtttcgtacagacctggtgtccattccgggaattgagagtaaacttcgcgtgctttcttctggaatggtccagtatcgggatagatcacttcgacgccggctgcctgcatggttttcaacatttcggcatcacgctcaagagtgagtttctggctatagacacccgcttcatagccggtctggtggatcatctccagttgttctggtgaaagggtgctaaagaaggcttcaccacctatccacactgaggtatttgtcaggtagttaaccattgtcagatatcttgcctgctcatacagtttttgcccttgcagcactgaaattgggttttctacgccgtcaataacgccctgggttaatgcgggataaacttcgcctaatggcatgggagttggtgttgcccccatcgcctgaatggcttttatttgcatgacgttattaggaacgcgaatttttaaacctgcgagatcgtcaacggtgcgaatgggttttttcgaaataatctgtcgagtgccatagagataattattcattaccacatgaattccctttttcttcagactttcatttttttgtttaaaccagtcgctttcatatattttgaacagtttttgcggatcgtcagtcagatacggtccaaacaaaatccccaaatcgggttcataatcggcaagaaaagccacatcactcaaggttatgacattcatgcccatcatggcttgctcggtgacatcctgttttgatcccaattgggagctgggatagagcgcaagtgttatttcgccattactttttttatttaataggtctgcccagtaacgcatgaccacatccaggggttctccagggttattttcataggcaacttttattgaaataggttttgcctggattattgacggtaaaaaaagggtactgacagtaattagcatcgctattattttgctcatctttacttactccatgctaaggaaataaaactccaacattgttgtcgggagtgaaaccttatgaaaaagcagtcattactgaaaagtagtcagcgaatagcagaatggctgcagatgtatcataaattcgtgcaccgggtaatactttgctgcttttaatcggtttttaatgcattttttgattgtatatcttaaagttatgtaatgcatgacgttacaaggaacaccctctgatgagtttagttaccgctgataagatctcttattctgttgatgatttattaaaaataaaatcattaatttggctgcggccattttaaattgtcaatacagataaaaactaagtgttgacgcagaatggtggtatccattaaatttatttagtgctgatttaatacatttgctgaacgtataattcatgctgatattaaaagaaaaccgtcattcactaaataacttgttcggcaaggaaatcagagagtaacggatgattcgttacaacggggaaaggcagtaaatattcacgtggtgaatttgttatcaacttgaaaactcattttactgggttccttctgatcatgtgagtgaacgcagtgattaatgattaacgttaagtgctaaccagagcgctttttatgaagttaaattaataatatccattatttatgaatgaggaagcctgtttattatatggaaatacttttaacaattttaattcttacgttggtagtatcattaaccagcgtgcttacacgtctgtctcctgtccagataccatttcctttaatccagattgccgctggcgcagtactggcccagcctatatttggtctgcatgtggaattcaatcctgaactttttctcttattgtttataccacccctgttgtttgctgaaagttcaaaaatacaacctaaagaattgatcaagcacagccgggaaattatcagcctggcacttgtgttggtactaatcactatttttggtgtcggctatgtgattcatttactcttaccgaatgtgccgctcatcgctgctttcgcattagccgccgtgttgtcgcctaccgatgccgtggcgttgctggggattgtcgggaaagggcgtatcagcaaaaacatccaggaagtgctcgaaggcgaagcgttgatgaatgatgcttccggcctggtggcgttgaaatttgctgttgcagtgacgatgggaacgatggaattcagcgttcatggcgcaaccattgcgttttttgtcgttgcgttgggcggtattgccgtggggatcgctgttacctggttatatggtaaagggctgctgttgatcagccgatatgctcacgatgaaccttccattcagattgtattgatgcttctgttgccgtttattgtttatctggttgcggaacattttggcttatctggcattcttgccgctgtcgccgcggggttaacaaccagtcgcattggtgtagtccaccacgcgcctattcgcctgagaattaaagctaaaagtagctggtcgatgcttgaatatgtctttaacggcatggtgtttctgattttaggcttacaactgccgggcattatttcggaatcactgatccgtgcagaaaacgatccactggtggacaccggatcgctgctccttgatgtcatttggatctacctggcgttaatggttgtgcgcctgggctggctttggctgatgcgtctgtatagccgtaaacgacccggcaaacatccgatgctgtttgctggatataaaacgcgtcatatgctgctggcgacctttgcgggggtgcgcggagctatcacgcttgcgggggtgctttctatcccgttattgctgccggatggcacaccttttcccgggcgttacttgctggtatttctcgccacaggtgtgatcctcttttcgctggtttgcggcattattattctgccgttattactggggaaaaatgtggggattttcagcgataaccgacaaaaagaagaggaagctgccgatctgtttatggctaaaatggccatactgagtgtgcaaaagaccgagcaacgtttgctgcgcgccagaacagaaaacctcgataacgagttgattatggaaacgggggccagagttatcggttatatgcgacatagtgaagaggatatgtcgcctaatgataattccctgcatatgcagcgtgcgaagctggaaagaacatttaatctggcggcgttaaatgccaaacgcgcggctatttaccagatgcgcgcaaggcaagaagtcagtgatgaaacactggcaaaaatagtcagtgaattagatgtgctggaaacgttaatcatggatagccgataattttatcgctgccagtaatagggaattaaatgatggctgagagtaatacttccagcatcgtttattccctatgtatttccttatgggcagaacaatcgcctggattaatactgcattaatacaacatagtgatataaaccaagaatcaatgtttttaatctgtacttaatttatcggtgatgttgcctgatggaacgaatcattgattgtttggcggtatccagatggtttcgcaacgccgttattgcatctaaatcgctacggcaaatcagggcgctgagaatggtcatatgttcatcaacagcaatgatattgcgctgtttgagatcgctttcatcccattgatagtgaaaatgaaagatcaccgatataatttcaagtgattgattaaaaaagatgttgtcagcagcggataacagcatggcatgaaaatcacggtctaattgagaaaacattcgaaagttgctgccaatgctgtcgcgcaatgtcctgtgacgttcgagcatggttttcgcctgcaaccagcgagggtcatcatcgggaaggttgagaaagtgttgcagggaatgtgtttcgagcatttcgcgtagctcaaacagctgctcggcgtaggattgatcgaactgcttcatgctccattggccgcgcttttcgctttgaataagattataacgaccgaatttcaaaagatattctcgtaccactaccggactgacgcttgccgctcgcgccagctgaagttcggaaaagctttctccggcgcgtaactggcgcaggttaatcatggtgaaaaatgcctgctcgaaaagacggttttgctctttcagcgaggccgtgatgcaatcaaatccatcgttctgttcgggtttgcgggcgataacataatttttccccaccagggtgagcacgccacatgcgcttaaatgctggagtatgtggcgtaccgtagtgcgactgatgttatacatttctgccagtccgctttgtgaaggcagcggagaaggaatattgcccctcgccatatcttcaatcacctgatttatgacgctatgacgtaaattctgcgaacgactcattcttccctccagtccggcattaaaagccgatttaaaacatttttatgcgcgatcatccgcatattttatgggtaaattcaggcgctcttataaattcgacgatatctgaaagtcataaaataaaaggagcggtgaatcatgtccacaatgaaagtattaatttgtcaggaaataaagaatttagtatgggaagtccgggaaagaccggtgccaggcgataatgaagcattaattaaaattaaaactgtcgggatttgcggtacagatattcatgcctgggcgggcaatcagccattttttagttatccacgcgttttaggccatgaaatatgtggggagattattgaatcaggaaaaaacattcacaattttaatatcggacagcaagttgcggtaattccgtatatttcttgtcagcaatgcccggcgtgtaaaagcggtcgtaccaattgctgtgaaaaaatttcagtcattggcgtgcatcaggatggcggttttagtgagtatttgagcgtgccggtggcgaacattttgcccgcagacggtattgacccgcaggcggcagcattgattgaacctttcgctattagcgctcatgcggtgcgtcgtgcagccattgcacccagcgagcaggtgctggtggtcggggcggggccaatcggtctgggcgcggcggcaatcgctaaagccgatggcgcgcaggtggtggtggcggataccagtccggcgcgtcgtgaacatgtggcaacgcgtctggaattacctgttctggacccgtcagccgaagattttgacgcgcagctgcgggcgcagtttggtggttcgctggcgcagaaagtgattgacgcgacaggtaatcaacatgcgatgaataacaccgtaaatctgattcgtcacggcggcacggtggtatttgtcggcctgtttaaaggtgagttgcagttctccgatccggaattccataaaaaagaaacgacgatgatgggcagccgcaacgccacgccggaagatttcgctaaagtcggtcgattgatggcggaagggaaaatcactgccgacatgatgttaacccatcgctatccgttcgccacgctggcagaaacctacgagcgcgatgtgattaacaatcgtgagttgattaagggcgtaattactttctgataaggcgagattattcaagttgccatgcagcgtccggggaagtgttgggcgctgttttttttctgtttctcaataatgttttgtaggccggagaaggtgtgtaggaaacctcaggaatatcactctgatcaccacggcgcatagccatgccaacagcttcattgaaatcaataaagttcatcctcttcacgccgcgggcgctaacagatttgctgtactgctggtaagcatcacgagtggcttccatctgcttataaagcatggcgtcgtattgcttaatcttagtctcgactgccgtaaacgtagccaacccctcatcatttttggcgaagaaatagttattttcggcaagctgctggttaatctgacgggagacaagagatggtgattgcgccaagcggccagcagagtgacactcaacgttttgttagcaagtccaagtcca
